United States Patent 8,586,006 (ORGAN-SPECIFIC PROTEINS AND METHODS OF THEIR USE) - sequence listing, part 8

SEQ ID NO: 9717 - protein, 2341 aa, Homo sapiens
MSARKLRNLSYKKAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9718 - protein, 1225 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9719 - protein, 956 aa, Homo sapiens
MLHRKTYHVKDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9720 - protein, 617 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9721 - protein, 635 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 9722 - protein, 604 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9723 - protein, 622 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 9724 - protein, 340 aa, Homo sapiens
MREQLKGHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMET

SEQ ID NO: 9725 - protein, 1105 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9726 - protein, 1243 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 9727 - protein, 1230 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 9728 - protein, 1133 aa, Homo sapiens
MPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGHNVGSLFHMADDLGRAMESLVSVMTDEEGAE

SEQ ID NO: 9729 - protein, 913 aa, Homo sapiens
MPGEAVEYHSIQLIRDEFLMNVQKFASNIQRTMQQLEGEIKLEMPIISVEGEVSDLAADPETVDILEQCVINWLNQISTAVEAQLKKTPQGKGPLAEIEFWRERNATLSALHEQTKLPIVRKVLDVIKESDSMLVANLQPVFTELFKFHTEASDNVRFLSTVERYFKNITHGSGFHVVLDTIPAMMSALRMVWIISRHYNKDERMIPLMERIAWEIAERVCRVVNLRTLFKENRASAQSKTLEARNTLRLWKKAYFDTRAKIEASGREDRWEFDRKRLFERTDYMATICQDLSDVLQVLEEFYNIFGPELKAVTGDPKRIDDVLCRVDGLVTPMENLTFDPFSIKSSQFWKYVMDEFKIEVLIDIINKIFVQNLENPPLYKNHPPVAGAIYWERSLFFRIKHTILRFQEVQEILDSDRGQEVKQKYLEVGRTMKEYEDRKYEQWMEVTEQVLPALMKKSLLTKSSIATEEPSTLERGAVFAINFSPALREIINETKYLEQLGFTVPELARNVALQEDKFLRYTAGIQRMLDHYHMLIGTLNDAESVLLKDHSQELLRVFRSGYKRLNWNSLGIGDYITGCKQAIGKFESLVHQIHKNADDISSRLTLIEAINLFKYPAAKSEEELPGVKEFFEHIERERASDVDHMVRWYLAIGPLLTKVEGLVVHTNTGKAPKLASYYKYWEKKIYEVLTKLILKNLQSFNSLILGNVPLFHTETILTAPEIILHPNTNEIDKMCFHCVRNCVEITKHFVRWMNGSCIECPPQKGEEEEVVIINFYNDISLNPQIIEQAVMIPQNVHRILINLMKYLQKWKRYRPLWKLDKAIVMEKFAAKKPPCVAYDEKLQFYSKIAYEVMRHPLIKDEHCIRLQLRHLANTVQENAKSWVISLGKLLNESAKEELYNLHEEMEVLNRCV

SEQ ID NO: 9730 - protein, 699 aa, Homo sapiens
MIPASAKAPHKQPHKQSISIGRGTRKRDEDSGTEVGEGTDEWAQSKATVRPPDQLELTDAELKEEFTRILTANNPHAPQNIVRYSFKEGTYKPIGFVNQLAVHYTQVGNLIPKDSDEGRRQHYRDELVAGSQESVKVISETGNLEEDEEPKELETEPGSQTDVPAAGAAEKVTEEELMTPKQPKERKLTNQFNFSERASQTYNNPVRDRECQTEPPPRTNFSATANQWEIYDAYVEELEKQEKTKEKEKAKTPVAKKSGKMAMRKLTSMESQTDDLIKLSQAAKIMERMVNQNTYDDIAQDFKYYDDAADEYRDQVGTLLPLWKFQNDKAKRLSVTALCWNPKYRDLFAVGYGSYDFMKQSRGMLLLYSLKNPSFPEYMFSSNSGVMCLDIHVDHPYLVAVGHYDGNVAIYNLKKPHSQPSFCSSAKSGKHSDPVWQVKWQKDDMDQNLNFFSVSSDGRIVSWTLVKRKLVHIDVIKLKVEGSTTEVPEGLQLHPVGCGTAFDFHKEIDYMFLVGTEEGKIYKCSKSYSSQFLDTYDAHNMSVDTVSWNPYHTKVFMSCSSDWTVKIWDHTIKTPMFIYDLNSAVGDVAWAPYSSTVFAAVTTDGKAHIFDLAINKYEAICNQPVAAKKNRLTHVQFNLIHPIIIVGDDRGHIISLKLSPNLRKMPKEKKGQEVQKGPAVEIAKLDKLLNLVREVKIKT

SEQ ID NO: 9731 - protein, 480 aa, Homo sapiens
MAARCSTRWLLVVVGTPRLPAISGRGARPPREGVVGAWLSRKLSVPAFASSLTSCGPRALLTLRPGVSLTGTKHYPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHYCGGSGMETINTGPFVMRSTCRRCGGRGSIIISPCVVCRGAGQAKQKKRVMIPVPAGVEDGQTVRMPVGKREIFITFRVQKSPVFRRDGADIHSDLFISIAQALLGGTARAQGLYETINVTIPPGTQTDQKIRMGGKGIPRINSYGYGDHYIHIKIRVPKRLTSRQQSLILSYAEDETDVEGTVNGVTLTSSGGSTMDSSAGSKARREAGEDEEGFLSKLKKMFTS

SEQ ID NO: 9732 - protein, 559 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTMGYLQWRWGIQSAMNTSIVRDTKTSHFTVALQLGIPHSFALIIYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 9733 - protein, 558 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTNLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 9734 - protein, 1865 aa, Homo sapiens
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQTSVDSGIVQ

SEQ ID NO: 9735 - protein, 1870 aa, Homo sapiens
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFGVAFVKLMNPDGTTLQDGRHDLVVYKGDNKKMEDAKFYLTLPGTKMEMEEKELQASKNLVTFTPSKDSTKDSFQIATLICSTKLTQNVDLLGLLNWRSNSQNIKHNLKKLMEVDGGEIVKFLQDTLDALFNIMMEMSDSETYDFLVFDALVFIISLIGDIKFQHFNPVLETYIYKHFSATLAYVKLSKVLNFYVANADDSSKTELLFAALKALKYLFRFIIQSRVLYLRFYGQSKDGDEFNNSIRQLFLAFNMLMDRPLEEAVKIKGAALKYLPSIINDVKLVFDPVELSVLFCKFIQSIPDNQLVRQKLNCMTKIVESTLFRQSECREVLLPLLTDQLSGQLDDNSNKPDHEASSQLLSNILEVLDRKDVGATAVHIQLIMERLLRRINRTVIGMNRQSPHIGSFVACMIALLQQMDDSHYSHYISTFKTRQDIIDFLMETFIMFKDLIGKNVYAKDWMVMNMTQNRVFLRAINQFAEVLTRFFMDQASFELQLWNNYFHLAVAFLTHESLQLETFSQAKRNKIVKKYGDMRKEIGFRIRDMWYNLGPHKIKFIPSMVGPILEVTLTPEVELRKATIPIFFDMMQCEFNFSGNGNFHMFENELITKLDQEVEGGRGDEQYKVLLEKLLLEHCRKHKYLSSSGEVFALLVSSLLENLLDYRTIIMQDESKENRMSCTVNVLNFYKEKKREDIYIRYLYKLRDLHRDCENYTEAAYTLLLHAELLQWSDKPCVPHLLQRDSYYVYTQQELKEKLYQEIISYFDKGKMWEKAIKLSKELAETYESKVFDYEGLGNLLKKRASFYENIIKAMRPQPEYFAVGYYGQGFPSFLRNKIFIYRGKEYERREDFSLRLLTQFPNAEKMTSTTPPGEDIKSSPKQYMQCFTVKPVMSLPPSYKDKPVPEQILNYYRANEVQQFRYSRPFRKGEKDPDNEFATMWIERTTYTTAYTFPGILKWFEVKQISTEEISPLENAIETMELTNERISNCVQQHAWDRSLSVHPLSMLLSGIVDPAVMGGFSNYEKAFFTEKYLQEHPEDQEKVELLKRLIALQMPLLTEGIRIHGEKLTEQLKPLHERLSSCFRELKEKVEKHYGVITLPPNLTERKQSRTGSIVLPYIMSSTLRRLSITSVTSSVVSTSSNSSDNAPSRPGSDGSILEPLLERRASSGARVEDLSLREENSENRISKFKRKDWSLSKSQVIAEKAPEPDLMSPTRKAQRPKSLQLMDNRLSPFHGSSPPQSTPLSPPPLTPKATRTLSSPSLQTDGIAATPVPPPPPPKSKPYEGSQRNSTELAPPLPVRREAKAPPPPPPKARKSGIPTSEPGSQ

SEQ ID NO: 9736 - protein, 2069 aa, Homo sapiens
MSQPPLLPASAETRKFTRALSKPGTAAELRQSVSEVVRGSVLLAKPKLIEPLDYENVIVQKKTQILNDCLREMLLFPYDDFQTAILRRQGRYICSTVPAKAEEEAQSLFVTECIKTYNSDWHLVNYKYEDYSGEFRQLPNKVVKLDKLPVHVYEVDEEVDKDEDAASLGSQKGGITKHGWLYKGNMNSAISVTMRSFKRRFFHLIQLGDGSYNLNFYKDEKISKEPKGSIFLDSCMGVVQNNKVRRFAFELKMQDKSSYLLAADSEVEMEEWITILNKILQLNFEAAMQEKRNGDSHEDDEQSKLEGSGSGLDSYLPELAKSAREAEIKLKSESRVKLFYLDPDAQKLDFSSAEPEVKSFEEKFGKRILVKCNDLSFNLQCCVAENEEGPTTNVEPFFVTLSLFDIKYNRKISADFHVDLNHFSVRQMLATTSPALMNGSGQSPSVLKGILHEAAMQYPKQGIFSVTCPHPDIFLVARIEKVLQGSITHCAEPYMKSSDSSKVAQKVLKNAKQACQRLGQYRMPFAWAARTLFKDASGNLDKNARFSAIYRQDSNKLSNDDMLKLLADFRKPEKMAKLPVILGNLDITIDNVSSDFPNYVNSSYIPTKQFETCSKTPITFEVEEFVPCIPKHTQPYTIYTNHLYVYPKYLKYDSQKSFAKARNIAICIEFKDSDEEDSQPLKCIYGRPGGPVFTRSAFAAVLHHHQNPEFYDEIKIELPTQLHEKHHLLLTFFHVSCDNSSKGSTKKRDVVETQVGYSWLPLLKDGRVVTSEQHIPVSANLPSGYLGYQELGMGRHYGPEIKWVDGGKPLLKISTHLVSTVYTQDQHLHNFFQYCQKTESGAQALGNELVKYLKSLHAMEGHVMIAFLPTILNQLFRVLTRATQEEVAVNVTRVIIHVVAQCHEEGLESHLRSYVKYAYKAEPYVASEYKTVHEELTKSMTTILKPSADFLTSNKLLKYSWFFFDVLIKSMAQHLIENSKVKLLRNQRFPASYHHAVETVVNMLMPHITQKFRDNPEASKNANHSLAVFIKRCFTFMDRGFVFKQINNYISCFAPGDPKTLFEYKFEFLRVVCNHEHYIPLNLPMPFGKGRIQRYQDLQLDYSLTDEFCRNHFLVGLLLREVGTALQEFREVRLIAISVLKNLLIKHSFDDRYASRSHQARIATLYLPLFGLLIENVQRINVRDVSPFPVNAGMTVKDESLALPAVNPLVTPQKGSTLDNSLHKDLLGAISGIASPYTTSTPNINSVRNADSRGSLISTDSGNSLPERNSEKSNSLDKHQQSSTLGNSVVRCDKLDQSEIKSLLMCFLYILKSMSDDALFTYWNKASTSELMDFFTISEVCLHQFQYMGKRYIARTGMMHARLQQLGSLDNSLTFNHSYGHSDADVLHQSLLEANIATEVCLTALDTLSLFTLAFKNQLLADHGHNPLMKKVFDVYLCFLQKHQSETALKNVFTALRSLIYKFPSTFYEGRADMCAALCYEILKCCNSKLSSIRTEASQLLYFLMRNNFDYTGKKSFVRTHLQVIISVSQLIADVVGIGGTRFQQSLSIINNCANSDRLIKHTSFSSDVKDLTKRIRTVLMATAQMKEHENDPEMLVDLQYSLAKSYASTPELRKTWLDSMARIHVKNGDLSEAAMCYVHVTALVAEYLTRKEAVQWEPPLLPHSHSACLRRSRGGVFRQGCTAFRVITPNIDEEASMMEDVGMQDVHFNEDVLMELLEQCADGLWKAERYELIADIYKLIIPIYEKRRDFERLAHLYDTLHRAYSKVTEVMHSGRRLLGTYFRVAFFGQAAQYQFTDSETDVEGFFEDEDGKEYIYKEPKLTPLSEISQRLLKLYSDKFGSENVKMIQDSGKVNPKDLDSKYAYIQVTHVIPFFDEKELQERKTEFERSHNIRRFMFEMPFTQTGKRQGGVEEQCKRRTILTAIHCFPYVKKRIPVMYQHHTDLNPIEVAIDEMSKKVAELRQLCSSAEVDMIKLQLKLQGSVSVQVNAGPLAYARAFLDDTNTKRYPDNKVKLLKEVFRQFVEACGQALAVNERLIKEDQLEYQEEMKANYREMAKELSEIMHEQLG

SEQ ID NO: 9737 - protein, 1025 aa, Homo sapiens
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRSCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 9738 - protein, 564 aa, Homo sapiens
MLANSASVRILIKGGKVVNDDCTHEADVYIENGIIQQVGRELMIPGGAKVIDATGKLVIPGGIDTSTHFHQTFMNATCVDDFYHGTKAALVGGTTMIIGHVLPDKETSLVDAYEKCRGLADPKVCCDYALHVGITWWAPKVKAEMETLVREKGVNSFQMFMTYKDLYMLRDSELYQVLHACKDIGAIARVHAENGELVAEGAKEALDLGITGPEGIEISRPEELEAEATHRVITIANRTHCPIYLVNVSSISAGDVIAAAKMQGKVVLAETTTAHATLTGLHYYHQDWSHAAAYVTVPPLRLDTNTSTYLMSLLANDTLNIVASDHRPFTTKQKAMGKEDFTKIPHGVSGVQDRMSVIWERGVVGGKMDENRFVAVTSSNAAKLLNLYPRKGRIIPGADADVVVWDPEATKTISASTQVQGGDFNLYENMRCHGVPLVTISRGRVVYENGVFMCAEGTGKFCPLRSFPDTVYKKLVQREKTLKVRGVDRTPYLGDVAVVVHPGKKEMGTPLADTPTRPVTRHGGMRDLHESSFSLSGSQIDDHVPKRASARILAPPGGRSSGIW

SEQ ID NO: 9739 - protein, 665 aa, Homo sapiens
MAHEMIGTQIVTERLVALLESGTEKVLLIDSRPFVEYNTSHILEAININCSKLMKRRLQQDKVLITELIQHSAKHKVDIDCSQKVVVYDQSSQDVASLSSDCFLTVLLGKLEKSFNSVHLLAGGFAEFSRCFPGLCEGKSTLVPTCISQPCLPVANIGPTRILPNLYLGCQRDVLNKELMQQNGIGYVLNASNTCPKPDFIPESHFLRVPVNDSFCEKILPWLDKSVDFIEKAKASNGCVLVHCLAGISRSATIAIAYIMKRMDMSLDEAYRFVKEKRPTISPNFNFLGQLLDYEKKIKNQTGASGPKSKLKLLHLEKPNEPVPAVSEGGQKSETPLSPPCADSATSEAAGQRPVHPASVPSVPSVQPSLLEDSPLVQALSGLHLSADRLEDSNKLKRSFSLDIKSVSYSASMAASLHGFSSSEDALEYYKPSTTLDGTNKLCQFSPVQELSEQTPETSPDKEEASIPKKLQTARPSDSQSKRLHSVRTSSSGTAQRSLLSPLHRSGSVEDNYHTSFLFGLSTSQQHLTKSAGLGLKGWHSDILAPQTSTPSLTSSWYFATESSHFYSASAIYGGSASYSAYSCSQLPTCGDQVYSVRRRQKPSDRADSRRSWHEESPFEKQFKRRSCQMEFGESIMSENRSREELGKVGSQSSFSGSMEIIEVS

SEQ ID NO: 9740 - protein, 381 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 9741 - protein, 235 aa, Homo sapiens
MIDTLRPVPFASEMAISKTVAWLNEQLELGNERLLLMDCRPQELYESSHIESAINVAIPGIMLRRLQKGNLPVRALFTRGEDRDRFTRRCGTDTVVLYDESSSDWNENTGGESVLGLLLKKLKDEGCRAFYLEDEARGKNCGVLVHCLAGISRSVTVTVAYLMQKLNLSMNDAYDIVKMKKSNISPNFNFMGQLLDFERTLGLSSPCDNRVPAQQLYFTTPSNQNVYQVDSLQST

SEQ ID NO: 9742 - protein, 638 aa, Homo sapiens
MSDKSELKAELERKKQRLAQIREEKKRKEEERKKKETDQKKEAVAPVQEESDLEKKRREAEALLQSMGLTPESPIVFSEYWVPPPMSPSSKSVSTPSEAGSQDSGDGAVGSRTLHWDTDPSVLQLHSDSDLGRGPIKLGMAKITQVDFPPREIVTYTKETQTPVMAQPKEDEEEDDDVVAPKPPIEPEEEKTLKKDEENDSKAPPHELTEEEKQQILHSEEFLSFFDHSTRIVERALSEQINIFFDYSGRDLEDKEGEIQAGAKLSLNRQFFDERWSKHRVVSCLDWSSQYPELLVASYNNNEDAPHEPDGVALVWNMKYKKTTPEYVFHCQSAVMSATFAKFHPNLVVGGTYSGQIVLWDNRSNKRTPVQRTPLSAAAHTHPVYCVNVVGTQNAHNLISISTDGKICSWSLDMLSHPQDSMELVHKQSKAVAVTSMSFPVGDVNNFVVGSEEGSVYTACRHGSKAGISEMFEGHQGPITGIHCHAAVGAVDFSHLFVTSSFDWTVKLWTTKNNKPLYSFEDNADYVYDVMWSPTHPALFACVDGMGRLDLWNLNNDTEVPTASISVEGNPALNRVRWTHSGREIAVGDSEGQIVIYDVGEQIAVPRNDEWARFGRTLAEINANRADAEEEAATRIPA

SEQ ID NO: 9743 - protein, 334 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLVLS

SEQ ID NO: 9744 - protein, 201 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPVSCCLGLLLESLVPFIVNDNITNNFFRFLCMT

SEQ ID NO: 9745 - protein, 351 aa, Homo sapiens
MPSETLWEIAKAEVEKRGINGSEGDGAEIAEKFVFFIGSKNGGKTTIILRCLDRDEPPKPTLALEYTYGRRAKGHNTPKDIAHFWELGGGTSLLDLISIPITGDTLRTFSLVLVLDLSKPNDLWPTMENLLQATKSHVDKVIMKLGKTNAKAVSEMRQKIWNNMPKDHPDHELIDPFPVPLVIIGSKYDVFQDFESEKRKVICKTLRFVAHYYGASLMFTSKSEALLLKIRGVINQLAFGIDKSKSICVDQNKPLFITAGLDSFGQIGSPPVPENDIGKLHAHSPMELWKKVYEKLFPPKSINTLKDIKDPARDPQYAENEVDEMRIQKDLELEQYKRSSSKSWKQIELDS

SEQ ID NO: 9746 - protein, 848 aa, Homo sapiens
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKVNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 9747 - protein, 867 aa, Homo sapiens
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 9748 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 9749 - protein, 436 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKAGPHVGNKLVMLFSVNIECDGTVNQNPTMWPERKSNNN

SEQ ID NO: 9750 - protein, 281 aa, Homo sapiens
MATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 9751 - protein, 647 aa, Homo sapiens
MRSGKASCTLETVWEDKHKYEEAERRFYEHEATQAAASAQQLPAEGPAMNGPGQDDPEDADEAEAPDGGSRRDPRKSQDSRKPLQKKRKRSPKSGLGPADLALLGLSAERVWLDKSLFDQAESSYRQKLADVAAQAAWPPALAPWGLCTHGNQVACHHVTWGIWVNKSSFDQAERAFVEWSQALLLAPDGSRRQGTPNTGQQVAVPDLAHQPSPPVNGQPPLGSLQALVREVWLEKPRYDAAERGFYEALFDGHPPGKVRLQERAGLAEGARRGRRDRRGRNILGNKRAGLRRADGEAPSALPYCYFLQKDAEAPWLSKPAYDSAECRHHAAEALRVAWCLEAASLSHRPGPRSGLSVSSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLEKSSPGHRATAPQTQHVSPMRQVEPPAKKPATPAEDDEDDDIDLFGSDNEEEDKEAAQLREERLRQYAEKKAKKPALVAKSSILLDVKPWDDETDMAQLEACVRSIQLDGLVWGASKLVPVGYGIRKLQIQCVVEDDKVGTDLLEEEITKFEEHVQSVDIAAFNKI

SEQ ID NO: 9752 - protein, 239 aa, Homo sapiens
MASEELACKLERRLRREEAEESGPQLAPLGAPAPEPKPEPEPPARAPTASADAELSAQLSRRLDINEGAARPRRCRVFNPYTEFPEFSRRLIKDLESMFKLYDAGRDGFIDLMELKLMMEKLGAPQTHLGLKSMIKEVDEDFDGKLSFREFLLIFHKAAAGELQEDSGLMALAKLSEIDVALEGVKGAKNFFEAKVQALSSASKFEAELKAEQDERKREEEERRLRQAAFQKLKANFNT

SEQ ID NO: 9753 - protein, 426 aa, Homo sapiens
MANDSGGPGGPSPSERDRQYCELCGKMENLLRCSRCRSSFYCCKEHQRQDWKKHKLVCQGSEGALGHGVGPHQHSGPAPPAAVPPPRAGAREPRKAAARRDNASGDAAKGKVKAKPPADPAAAASPCRAAAGGQGSAVAAEAEPGKEEPPARSSLFQEKANLYPPSNTPGDALSPGGGLRPNGQTKPLPALKLALEYIVPCMNKHGICVVDDFLGKETGQQIGDEVRALHDTGKFTDGQLVSQKSDSSKDIRGDKITWIEGKEPGCETIGLLMSSMDDLIRHCNGKLGSYKINGRTKAMVACYPGNGTGYVRHVDNPNGDGRCVTCIYYLNKDWDAKVSGGILRIFPEGKAQFADIEPKFDRLLFFWSDRRNPHEVQPAYATRYAITVWYFDADERARAKVKYLTGEKGVRVELNKPSDSVGKDVF

SEQ ID NO: 9754 - protein, 1231 aa, Homo sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRRALATSSINMKQYASPMPTQTDVKLKFKPLSKKVVSAALQFSLSCIFLREGKATDEDMQSLASLMSMKQADIGNLDDFEEDNEDDDENRVNQEEKAAKITGIVNQLNALSSLDEDQDDCIKQANMRSAKSASSSEELINKLNFLVEAEKDLATVNSNPFDDPDAAELNPFGDPDSEEPITETASPRKTEDSFYNNSYNPFKEVQTPQYLNPFDEPEAFVTIKDSPPQSTKGKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 9755 - protein, 1523 aa, Homo sapiens
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPVRLRLKPKSVKVVQAELSLTLSGVLLREGRATDDDMQSLASLMSVKPSDVGNLDDFAESDEDEAHGPGAPEARARVPQPDPSRELKTLCEEEEEGQGRPQQAVASPSNAEDTSPAPVSAPAPPARTSRGQGSERANEAGGQVGPEAPRPPETSPEMRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKVRHVDTKGPEATGVMPEARCRGTPEAPPRGSQGRLGVRTRDEAPSGLSLPPAEPAGHSGQLGDLEGARAAAGQEREGAEVRGGAPGIEGTGLEQGPSVGAISTRPQVSSWQGALLSTAQGAISRGLGGWEAEAGGSGDLETETEVVGLEVLGTQEKEVEGSGFPETRTLEIEILGALEKEAARSRVLESEVAGTAQCEGLETQETEVGVIETPGTETEVLGTQKTEAGGSGVLQTRTTIAETEVLVTQEISGDLGPLKIEDTIQSEMLGTQETEVEASRVPESEAEGTEAKILGTQEITARDSGVREIEAEIAESDILVAQEIEVGLLGVLGIETGAAEGAILGTQEIASRDSGVPGLEADTTGIQVKEVGGSEVPEIATGTAETEILGTQEIASRSSGVPGLESEVAGAQETEVGGSGISGPEAGMAEARVLMTRKTEIIVPEAEKEEAQTSGVQEAETRVGSALKYEALRAPVTQPRVLGSQEAKAEISGVQGSETQVLRVQEAEAGVWGMSEGKSGAWGAQEAEMKVLESPENKSGTFKAQEAEAGVLGNEKGKEAEGSLTEASLPEAQVASGAGAGAPRASSPEKAEEDRRLPGSQAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEGLVNGAGAPGGGGVRLRRPSVNGEPGSVPPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 9756 - protein, 89 aa, Homo sapiens
MTSVWKRLQRVGKRAAKFQFVACYHELVLECTKKWQPDKLVVVWTRRNRRICSKAHSWQPGIQNPYRGTVVWMVPENVDISVTLYRVSL

SEQ ID NO: 9757 - protein, 43 aa, Homo sapiens
MQLRSLMESGANKLQEEVLIQEWFTLVNKKNALIRRQDQLQLL

SEQ ID NO: 9758 - protein, 43 aa, Homo sapiens; identical to SEQ ID NO: 9757

SEQ ID NO: 9759 - protein, 95 aa, Homo sapiens
MEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 9760 - protein, 538 aa, Homo sapiens
MRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 9761 - protein, 636 aa, Homo sapiens
MRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNAVAGRASKDGGAEAPRESRPAEVPAEGLVNGAGAPGGGGVRLRRPSVNGEPGSVPPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 9762 - protein, 565 aa, Homo sapiens [sequence omitted]

SEQ ID NO: 9763 - protein, 1523 aa, Homo sapiens
  VARIANT 1239, 1240, 1241, 1242, 1243, 1244, 1245, 1246, 1247, 1248,1249, 1250, 1251, 1252, 1253: Xaa = Any Amino Acid
MTSVWKRLQRVGKRAAKFQFVACYHELVLECTKKWQPDKLVVVWTRRNRRICSKAHSWQPGIQNPYRGTVVWMVPENVDISVTLYRDPHVDQYEAKEWTFIIENESKGQRKVLATAEVDLARHAGPVPVQVPLRLRLKPKSVKVVQAELSLTLSGVLLREGRATDDDMQSLASLMSVKPSDVGNLDDFAESDEDEAHGPGAPEARARVPQPDPSRELKTLCEEEEEGQGRPQQAVASPSNAEDTSPAPVSAPAPPARTSRGQGSERANEAGGQVGPEAPRPPETSPEMRSSRQPAQDTAPTPAPRLRKGSDALRPPVPQGEDEVPKASGAPPAGLGSARETQAQACPQEGTEAHGARLGPSIEDKGSGDPFGRQRLKAEEMDTEDRPEASGVDTEPRSGGREANTKRSGVRAGEAEESSAVCQVDAEQRSKVRHVDTKGPEATGVMPEARCRGTPEAPPRGSQGRLGVRTRDEAPSGLSLPPAEPAGHSGQLGDLEGARAAAGQEREGAEVRGGAPGIEGTGLEQGPSVGAISTRPQVSSWQGALLSTAQGAISRGLGGWEAEAGGSGVLETETEVVGLEVLGTQEKEVEGSGFPETRTLEIEILGALEKEAARSRVLESEVAGTAQCEGLETQETEVGVIETPGTETEVLGTQKTEAGGSGVLQTRTTIAETEVLVTQEISGDLGPLKIEDTIQSEMLGTQETEVEASRVPESEAEGTEAKILGTQEITARDSGVREIEAEIAESDILVAQEIEVGLLGVLGIETGAAEGAILGTQEIASRDSGVPGLEADTTGIQVKEVGGSEVPEIATGTAETEILGTQEIASRSSGVPGLESEVAGAQETEVGGSGISGPEAGMAEARVLMTRKTEIIVPEAEKEEAQTSGVQEAETRVGSALKYEALRAPVTQPRVLGSQEAKAEISGVQGSETQVLRVQEAEAGVWGMSEGKSGAWGAQEAEMKVLESPENKSGTFKAQEAEAGVLGNEKGKEAEGSLTEASLPEAQVASGAGAGAPRASSPEKAEEDRRLPGSQAPPALVSSSQSLLEWCQEVTTGYRGVRITNFTTSWRNGLAFCAILHRFYPDKIDYASLDPLNIKQNNKQAFDGFAALGVSRLLEPADMVLLSVPDKLIVMTYLCQIRAFCTGQELQLVQLEGGGGAGTYRVGSAQPSPPDDLDAGGLAQRLRGHGAEGPQEPKEAADRADGAAPGVASRNSVAGRASKDGGAEAPRESRPAEVPAEGXXXXXXXXXXXXXXXRRPSVNGEPGSVPPPRAHGSFSHVRDADLLKKRRSRLRNSSSFSMDDPDAGAMGAAAAEGQAPDPSPAPGPPTAADSQQPPGGSSPSEEPPPSPGEEAGLQRFQDTSQYVCAELQALEQEQRQIDGRAAEVEMQLRSLMESGANKLQEEVLIQEWFTLVNKKNALIRRQDQLQLLMEEQDLERRFELLSRELRAMLAIEDWQKTSAQQHREQLLLEELVSLVNQRDELVRDLDHKERIALEEDERLERGLEQRRRKLSRQLSRRERCVLS

SEQ ID NO: 9764 - protein, 89 aa, Homo sapiens; identical to SEQ ID NO: 9756

SEQ ID NO: 9765 - protein, 43 aa, Homo sapiens; identical to SEQ ID NO: 9757

SEQ ID NO: 9766 - protein, 43 aa, Homo sapiens; identical to SEQ ID NO: 9757

SEQ ID NO: 9767 - protein, 95 aa, Homo sapiens; identical to SEQ ID NO: 9759

SEQ ID NO: 9768 - protein, 538 aa, Homo sapiens; identical to SEQ ID NO: 9760

SEQ ID NO: 9769 - protein, 1649 aa, Homo sapiens
MAGGRGAPGRGRDEPPESYPQRQDHELQALEAIYGADFQDLRPDACGPVKEPPEINLVLYPQGLTGEEVYVKVDLRVKCPPTYPDVVPEIELKNAKGLSNESVNLLKSRLEELAKKHCGEVMIFELAYHVQSFLSEHNKPPPKSFHEEMLERRAQEEQQRLLEAKRKEEQEQREILHEIQRRKEEIKEEKKRKEMAKQERLEIASLSNQDHTSKKDPGGHRTAAILHGGSPDFVGNGKHRANSSGRSRRERQYSVCNSEDSPGSCEILYFNMGSPDQLMVHKGKCIGSDEQLGKLVYNALETATGGFVLLYEWVLQWQKKMGPFLTSQEKEKIDKCKKQIQGTETEFNSLVKLSHPNVVRYLAMNLKEQDDSIVVDILVEHISGVSLAAHLSHSGPIPVHQLRRYTAQLLSGLDYLHSNSVVHKVLSASNVLVDAEGTVKITDYSISKRLADICKEDVFEQTRVRFSDNALPYKTGKKGDVWRLGLLLLSLSQGQECGEYPVTIPSDLPADFQDFLKKCVCLDDKERWSPQQLLKHSFINPQPKMPLVEQSPEDSEGQDYVETVIPSNRLPSAAFFSETQRQFSRYFIEFEELQLLGKGAFGAVIKVQNKLDGCCYAVKRIPINPASRQFRRIKGEVTLLSRLHHENIVRYYNAWIERHERPAGPGTPPPDSGPLAKDDRAARGQPASDTDGLDSVEAAAPPPILSSSVEWSTSGERSASARFPATGPGSSDDEDDDEDEHGGVFSQSFLPASDSESDIIFDNEDENSKSQNQDEDCNEKNGCHESEPSVTTEAVHYLYIQMEYCEKSTLRDTIDQGLYRDTVRLWRLFREILDGLAYIHEKGMIHRDLKPVNIFLDSDDHVKIGDFGLATDHLAFSADSKQDDQTGDLIKSDPSGHLTGMVGTALYVSPEVQGSTKSAYNQKVDLFSLGIIFFEMSYHPMVTASERIFVLNQLRDPTSPKFPEDFDDGEHAKQKSVISWLLNHDPAKRPTATELLKSELLPPPQMEESELHEVLHHTLTNVDGKAYRTMMAQIFSQRISPAIDYTYDSDILKGNFSIRTAKMQQHVCETIIRIFKRHGAVQLCTPLLLPRNRQIYEHNEAALFMDHSGMLVMLPFDLRIPFARYVARNNILNLKRYCIERVFRPRKLDRFHPKELLECAFDIVTSTTNSFLPTAEIIYTIYEIIQEFPALQERNYSIYLNHTMLLKAILLHCGIPEDKLSQVYIILYDAVTEKLTRREVEAKFCNLSLSSNSLCRLYKFIEQKGDLQDLMPTINSLIKQKTGIAQLVKYGLKDLEEVVGLLKKLGIKLQVLINLGLVYKVQQHNGIIFQFVAFIKRRQRAVPEILAAGGRYDLLIPQFRGPQALGPVPTAIGVSIAIDKISAAVLNMEESVTISSCDLLVVSVGQMSMSRAINLTQKLWTAGITAEIMYDWSQSQEELQEYCRHHEITYVALVSDKEGSHVKVKSFEKERQTEKRVLETELVDHVLQKLRTKVTDERNGREASDNLAVQNLKGSFSNASGLFEIHGATVVPIVSVLAPEKLSASTRRRYETQVQTRLQTSLANLHQKSSEIEILAVDLPKETILQFLSLEWDADEQAFNTTVKQLLSRLPKQRYLKLVCDEIYNIKVEKKVSVLFLYSYRDDYYRILF

SEQ ID NO: 9770 - protein, 721 aa, Homo sapiens
MAAPVVAPPGVVVSRANKRSGAGPGGSGGGGARGAEEEPPPPLQAVLVADSFDRRFFPISKDQPRVLLPLANVALIDYTLEFLTATGVQETFVFCCWKAAQIKEHLLKSKWCRPTSLNVVRIITSELYRSLGDVLRDVDAKALVRSDFLLVYGDVISNINITRALEEHRLRRKLEKNVSVMTMIFKESSPSHPTRCHEDNVVVAVDSTTNRVLHFQKTQGLRRFAFPLSLFQGSSDGVEVRYDLLDCHISICSPQVAQLFTDNFDYQTRDDFVRGLLVNEEILGNQIHMHVTAKEYGARVSNLHMYSAVCADVIRRWVYPLTPEANFTDSTTQSCTHSRHNIYRGPEVSLGHGSILEENVLLGSGTVIGSNCFITNSVIGPGCHIGDNVVLDQTYLWQGVRVAAGAQIHQSLLCDNAEVKERVTLKPRSVLTSQVVVGPNITLPEGSVISLHPPDAEEDEDDGEFSDDSGADQEKDKVKMKGYNPAEVGAAGKGYLWKAAGMNMEEEEELQQNLWGLKINMEEESESESEQSMDSEEPDSRGGSPQMDDIKVFQNEVLGTLQRGKEENISCDNLVLEINSLKYAYNISLKEVMQVLSHVVLEFPLQQMDSPLDSSRYCALLLPLLKAWSPVFRNYIKRAADHLEALAAIEDFFLEHEALGISMAKVLMAFYQLEILAEETILSWFSQRDTTDKGQQLRKNQQLQRFIQWLKEAEEESSEDD

SEQ ID NO: 9771 - protein, 859 aa, Homo sapiens
MYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 9772 - protein, 333 aa, Homo sapiens
MSGDEMIFDPTMSKKKKKKKKPFMLDEEGDTQTEETQPSETKEVEPEPTEDKDLEADEEDTRKKDASDDLDDLNFFNQKKKKKKTKKIFDIDEAEEGVKDLKIESDVQEPTEPEDDLDIMLGNKKKKKKNVKFPDEDEILEKDEALEDEDNKKDDGISFSNQTGPAWAGSERDYTYEELLNRVFNIMREKNPDMVAGEKRKFVMKPPQVVRVGTKKTSFVNFTDICKLLHRQPKHLLAFLLAELGTSGSIDGNNQLVIKGRFQQKQIENVLRRYIKEYVTCHTCRSPDTILQKDTRLYFLQCETCHSRCSVASIKTGFQAVTGKRAQLRAKAN

SEQ ID NO: 9773 - protein, 548 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDKDRRNMLQFNLQILPKSAKQKERERIRLQKKFQKQFGVRQKWDQKSQKPRDSSVEVRSDWEVKEEMDFPQLMKMRYLEVSEPQDIECCGALEYYDKAFDRITTRSEKPLRSIKRIFHTVTTTDDPVIRKLAKTQGNVFATDAILATLMSCTRSVYSWDIVVQRVGSKLFFDKRDNSDFDLLTVSETANEPPQDEGNSFNSPRNLAMEATYINHNFSQQCLRMGKERYNFPNPNPFVEDDMDKNEIASVAYRYRRWKLGDDIDLIVRCEHDGVMTGANGEVSFINIKTLNEWDSRHCNGVDWRQKLDSQRGAVIATELKNNSYKLARWTCCALLAGSEYLKLGYVSRYHVKDSSRHVILGTQQFKPNEFASQINLSVENAWGILRCVIDICMKLEEGKYLILKDPNKQVIRVYSLPDGTFSSDEDEEEEEEEEEEEEEEET

SEQ ID NO: 9774 - protein, 118 aa, Homo sapiens
MRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKPHEEHHAFEGGRGKH

SEQ ID NO: 9775 - protein, 985 aa, Homo sapiens
MDRRSMGETESGDAFLDLKKPPASKCPHRYTKEELLDIKELPHSKQRPSCLSEKYDSDGVWDPEKWHASLYPASGRSSPVESLKKELDTDRPSLVRRIVDPRERVKEDDLDVVFSPQRRSFGGGCHVTAAVSSRRSGSPLEKDSDGLRLLGGRRIGSGRIISARTFEKDHRLSDKDLRDLRDRDRERDFKDKRFRREFGDSKRVFGERRRNDSYTEEEPEWFSAGPTSQSETIELTGFDDKILEEDHKGRKRTRRRTASVKEGIVECNGGVAEEDEVEVILAQEPAADQEVPRDAVLPEQSPGDFDFNEFFNLDKVPCLASMIEDVLGEGSVSASRFSRWFSNPSRSGSRSSSLGSTPHEELERLAGLEQAILSPGQNSGNYFAPIPLEDHAENKVDILEMLQKAKVDLKPLLSSLSANKEKLKESSHSGVVLSVEEVEAGLKGLKVDQQVKNSTPFMAEHLEETLSAVTNNRQLKKDGDMTAFNKLVSTMKASGTLPSQPKVSRNLESHLMSPAEIPGQPVPKNILQELLGQPVQRPASSNLLSGLMGSLEPTTSLLGQRAPSPPLSQVFQTRAASADYLRPRIPSPIGFTPGPQQLLGDPFQGMRKPMSPITAQMSQLELQQAALEGLALPHDLAVQAANFYQPGFGKPQVDRTRDGFRNRQQRVTKSPAPVHRGNSSSPAPAASITSMLSPSFTPTSVIRKMYESKEKSKEEPASGKAALGDSKEDTQKASEENLLSSSSVPSADRDSSPTTNSKLSALQRSSCSTPLSQANRYTKEQDYRPKATGRKTPTLASPVPTTPFLRPVHQVPLVPHVPMVRPAHQLHPGLVQRMLAQGVHPQHLPSLLQTGVLPPGMDLSHLQGISGPILGQPFYPLPAASHPLLNPRPGTPLHLAMVQQQLQRSVLHPPGSGSHAAAVSVQTTPQNVPSRSGLPHMHSQLEHRPSQRSSSPVGLAKWFGSDVLQQPLPSMPAKVISVDELEYRQ

SEQ ID NO: 9776 - protein, 1403 aa, Homo sapiens
MSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 9777 - protein, 1599 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 9778 - protein, 1599 aa, Homo sapiens; identical to SEQ ID NO: 9777

SEQ ID NO: 9779 - protein, 1435 aa, Homo sapiens
MNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 9780 - protein, 1512 aa, Homo sapiens
MMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 9781 - protein, 154 aa, Homo sapiens
MADDLDFETGDAGASATFPMQCSALRKNGFVVLKGRPCKIVEMSTSKTGKHGHAKVHLVGIDIFTGKKYEDICPSTHNMDVPNIKRNDFQLIGIQDGYLSLLQDSGEVREDLRLPEGDLGKEIEQKYDCGEEILITVLSAMTEEAAVAIKAMAK

SEQ ID NO: 9782 - protein, 380 aa, Homo sapiens
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACSPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 9783 - protein, 283 aa, Homo sapiens [sequence omitted]

SEQ ID NO: 9784 - protein, 1016 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 9785 - protein, 625 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTREYPRPPQ

SEQ ID NO: 9786 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 9787 - protein, 2414 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 9788 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 9789 - protein, 539 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDCMYYFNAV

SEQ ID NO: 9790 - protein, 1037 aa, Homo sapiens
MRGSGPRGAGHRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 9791 - protein, 1015 aa, Homo sapiens
MRGSGPRGAGHRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKECPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGRRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 9792 - protein, 1147 aa, Homo sapiens [sequence omitted]

SEQ ID NO: 9793 - protein, 547 aa, Homo sapiens
MQFPSPPAARSSPAPQAASSSEAAAPATGQPGPSCPVPGTSRRGRPGTPPAGRVEEEEEEEEEDVDKDPHPTQNTCLRCRHFSLRERKREPRRTMGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDGKFHCCSLKTDP

SEQ ID NO: 9794 - protein, 1186 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 9795 - protein, 974 aa, Homo sapiens
MRRAGIGEDSRLGLQAQPGAEPSPGRAGTERSLGGAQGPGQPCSCPGAMASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 9796 - protein, 473 aa, Homo sapiens
MAAEAAGGKYRSTVSKSKDPSGLLISVIRTLSTSDDVEDRENEKGRLEEAYEKCDRDLDELIVQHYTELTTAIRTYQSITERITNSRNKIKQVKENLLSCKMLLHCKRDELRKLWIEGIEHKHVLNLLDEIENIKQVPQKLEQCMASKHYLSATDMLVSAVESLEGPLLQVEGLSDLRLELHSKKMNLHLVLIDELHRHLYIKSTSRVVQRNKEKGKISSLVKDASVPLIDVTNLPTPRKFLDTSHYSTAGSSSVREINLQDIKEDLELDPEENSTLFMGILIKGLAKLKKIPETVKAIIERLEQELKQIVKRSTTQVADSGYQRGENVTVENQPRLLLELLELLFDKFNAVAAAHSVVLGYLQDTVVTPLTQQEDIKLYDMADVWVKIQDVLQMLLTEYLDMKNTRTASEPSAQLSYASTGREFAAFFAKKKPQRPKNSLFKFESSSHAISMSAYLREQRRELYSRSGELQG

SEQ ID NO: 9797 - protein, 974 aa, Homo sapiens [sequence omitted]

SEQ ID NO: 9798 - protein, 885 aa, Homo sapiens
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMFLPSLGHRAPVSQAAKFDPSTKIYEISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 9799 - protein, 860 aa, Homo sapiens
MAPPSTREPRVLSATSATKSDGEMVLPGFPDADSFVKFALGSVVAVTKASGGLPQFGDEYDFYRSFPGFQAFCETQGDRLLQCMSRVMQYHGCRSNIKDRSKVTELEDKFDLLVDANDVILERVGILLDEASGVNKNQQPVLPAGLQVPKTVVSSWNRKAAEYGKKAKSETFRLLHAKNIIRPQLKFREKIDNSNTPFLPKIFIKPNAQKPLPQALSKERRERPQDRPEDLDVPPALADFIHQQRTQQVEQDMFAHPYQYELNHFTPADAVLQKPQPQLYRPIEETPCHFISSLDELVELNEKLLNCQEFAVDLEHHSYRSFLGLTCLMQISTRTEDFIIDTLELRSDMYILNESLTDPAIVKVFHGADSDIEWLQKDFGLYVVNMFDTHQAARLLNLGRHSLDHLLKLYCNVDSNKQYQLADWRIRPLPEEMLSYARDDTHYLLYIYDKMRLEMWERGNGQPVQLQVVWQRSRDICLKKFIKPIFTDESYLELYRKQKKHLNTQQLTAFQLLFAWRDKTARREDESYGYVLPNHMMLKIAEELPKEPQGIIACCNPVPPLVRQQINEMHLLIQQAREMPLLKSEVAAGVKKSGPLPSAERLENVLFGPHDCSHAPPDGYPIIPTSGSVPVQKQASLFPDEKEDNLLGTTCLIATAVITLFNEPSAEDSKKGPLTVAQKKAQNIMESFENPFRMISNRWKLAQVQVQKDSKEAVKKKAAEQTAAREQAKEACKAAAEQAISVRQQVVLENAAKKRERATSDPRTTEQKQEKKRLKISKKPKDPEPPEKEFTPYDYSQSDFKAFAGNSKSKVSSQFDPNKQTPSGKKCIAAKKIKQSVGNKSMSFPTGKSDRGFRYNWPQR

SEQ ID NO: 9800 - protein, 293 aa, Homo sapiens
MAMEMRLPVARKPLSERLGRDTKKHLVVPGDTITTDTGFMRGHGTYMGEEKLIASVAGSVERVNKLICVKALKTRYIGEVGDIVVGRITEVQQKRWKVETNSRLDSVLLLSSMNLPGGELRRRSAEDELAMRGFLQEGDLISAEVQAVFSDGAVSLHTRSLKYGKLGQGVLVQVSPSLVKRQKTHFHDLPCGASVILGNNGFIWIYPTPEHKEEEAGGFIANLEPVSLADREVISRLRNCIISLVTQRMMLYDTSILYCYEASLPHQIKDILKPEIMEEIVMETRQRLLEQEG

SEQ ID NO: 9801 - protein, 425 aa, Homo sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLVLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISSCIDPLIYYYASSECQRYVYSILCCKESSDPSSYNSSGQLMASKMDTCSSNLNNSIYKKLLT

SEQ ID NO: 9802 - protein, 132 aa, Homo sapiens
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMTLTFGDVVAVRHYEKA

SEQ ID NO: 9803 - protein, 444 aa, Homo sapiens
MAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 9804 - protein, 650 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQESLNQNFMLIITHREVQREYNLNFSGSSTIQEVKRNVYDLTSIPVRHQLWEGWPTSATDDSMCLAESGLSYPCHRLTVGRRSSPAQTREQSEEQITDVHMVSDSDGDDFEDATEFGVDDGEVFGMASSALRKSPMMPENAENEGDALLQFTAEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 9805 - protein, 498 aa, Homo sapiens
MASNMDREMILADFQACTGIENIDEAITLLEQNNWDLVAAINGVIPQENGILQSEYGGETIPGPAFNPASHPASAPTSSSSSAFRPVMPSRQIVERQPRMLDFRVEYRDRNVDVVLEDTCTVGEIKQILENELQIPVSKMLLKGWKTGDVEDSTVLKSLHLPKNNSLYVLTPDLPPPSSSSHAGALQEFSSRYGDCHPVFFIGSLEAAFQEAFYVKARDRKLLAIYLHHDESVLTNVFCSQMLCAESIVSYLSQNFITWAWDLTKDSNRARFLTMCNRHFGSVVAQTIRTQKTDQFPLFLIIMGKRSSNEVLNVIQGNTTVDELMMRLMAAMEIFTAQQQEDIKDEDEREARENVKREQDEAYRLSLEADRAKREAHEREMAEQFRLEQIRKEQEEEREAIRLSLEQALPPEPKEENAEPVSKLRIRTPSGEFLERRFLASNKLQIVFDFVASKGFPWDEYKLLSTFPRRDVTQLDPNKSLLEVKLFPQETLFLEAKE

SEQ ID NO: 9806 - protein, 249 aa, Homo sapiens
MKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLRLVVRELEQQLAAVRGGGGMALPQPQPQSLPLPPSLPSALAPVPSLPSAPAPVPALPLPRRPSALPPKENGCAVWSTEATFRPGPEPPPPPPRRRASAPHGPLDMAPFARLHECYGQEIRALRGQWLSSRVQP

SEQ ID NO: 9807 - protein, 131 aa, Homo sapiens
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRVTH

SEQ ID NO: 9808 - protein, 324 aa, Homo sapiens
MGNLLKVLTCTDLEQGPNFFLDFENAQPTESEKEIYNQVNVVLKDAEGILEDLQSYRGAGHEIREAIQHPADEKLQEKAWGAVVPLVGKLKKFYEFSQRLEAALRGLLGALTSTPYSPTQHLEREQALAKQFAEILHFTLRFDELKMTNPAIQNDFSYYRRTLSRMRINNVPAEGENEVNNELANRMSLFYAEATPMLKTLSDATTKFVSENKNLPIENTTDCLSTMASVCRVMLETPEYRSRFTNEETVSFCLRVMVGVIILYDHVHPVGAFAKTSKIDMKGCIKVLKDQPPNSVEGLLNALRYTTKHLNDETTSKQIKSMLQ

SEQ ID NO: 9809 - protein, 783 aa, Homo sapiens
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 9810 - protein, 365 aa, Homo sapiens
MHLRRVRTMPRHSQSLTMAPYSSVSLVEQLEDRILCHEKTTAALVEHAFRIKDDIVNSLQKMQNKGGGDRLARLFLEEHIRNITAIVKQLNRDIEVLQEQIRARDNISYGTNSALKTLEMRQLSGLGDLRGRVARCDASIARLSAEHKTTYEGLQHLNKEQQAAKLILETKIKDAEGQISQLLNRVDLSISEQSTKLKMSHRDSNHQLQLLDTKFKGTVEELSNQILSARSWLQQEQERIEKELLQKIDQLSLIVKENSGASERDMEKKLSQMSARLDKIEEGQKKTFDGQRTRQEEEKMHGRITKLELQMNQNIKEMKAEVNAGFTAVYESIGSIRQVLEAKMKLDRDQLQKQIQLMQKPETPM

SEQ ID NO: 9811 - protein, 219 aa, Homo sapiens
MNFADEFAKLQDYRQAEVERLEAKVVEPLKTYGTIVKMKRDDLKATLTARNREAKQLTQLERTRQRNPSDRHVISQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 9812 - protein, 132 aa, Homo sapiens
MMRRTLENRNAQTKQLQTAVSNVEKHFGELCQIFAAYVRKTARLRDKADLLVNEINAYAATETPHLKLGLMNFADEFAKLQDYRQAENLKREFQFSKNRMSIKKIELIIAIHTNLKSNHIWRYFWKNVEFLS

SEQ ID NO: 9813 - protein, 147 aa, Homo sapiens
MGPLRRIPTLSGRLHGPRCDLGPNSLGCSHRRRRRGARGPAGCHPPTPPGLGSPHCRGQCGSLGGSRAPRPRCAEQPEQPPPQLRPGPPGLGLFLCLHSPDSEERSNETTANSCLKCGEAFWRTVPNLRCLCAENCQAERQSRPPGE

SEQ ID NO: 9814 - protein, 213 aa, Homo sapiens
MVEVLMNNDKKVERLEAKVVEPLKTYGTIVKMKRDDLKATLTARNREAKQLTQLERTRQRNPSDRHVISQAETELQRAAMDASRTSRHLEETINNFERQKMKDIKTIFSEFITIEMLFHGKALEVYTAAYQNIQNIDEDEDLEVFRNSLYAPDYSSRLDIVRANSKSPLQRSLSAKCVSGTGQVSTCRLRKDQQAEDDEDDELDVTEEENFLK

SEQ ID NO: 9815 - protein, 219 aa, Homo sapiens; identical to SEQ ID NO: 9811

SEQ ID NO: 9816 - protein, 219 aa, Homo sapiens; identical to SEQ ID NO: 9811

SEQ ID NO: 9817 - protein, 132 aa, Homo sapiens; identical to SEQ ID NO: 9812

SEQ ID NO: 9818 - protein, 147 aa, Homo sapiens; identical to SEQ ID NO: 9813

SEQ ID NO: 9819 - protein, 213 aa, Homo sapiens; identical to SEQ ID NO: 9814

SEQ ID NO: 9820 - protein, 219 aa, Homo sapiens; identical to SEQ ID NO: 9811

SEQ ID NO: 9821 - protein, 375 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 9822 - protein, 129 aa, Homo sapiens
MGEIEQRPTPGSRLGAPENSGISTLERGQKPPPTPSGKLVSIKIQMLDDTQEAFEVPMVSSSSFLKAIGSSWTGWVLRCSMKPKHHSHLIEKFGEDRILTHLTGSISYTNWAGSRSLAVTVTEELLNLF

SEQ ID NO: 9823 - protein, 1045 aa, Homo sapiens
MGEIEQRPTPGSRLGAPENSGISTLERGQKPPPTPSGKLVSIKIQMLDDTQEAFEVPQRAPGKVLLDAVCNHLNLVEGDYFGLEFPDHKKITVWLDLLKPIVKQIRRPKHVVVKFVVKFFPPDHTQLQEELTRYLFALQVKQDLAQGRLTCNDTSAALLISHIVQSEIGDFDEALDREHLAKNKYIPQQDALEDKIVEFHHNHIGQTPAESDFQLLEIARRLEMYGIRLHPAKDREGTKINLAVANTGILVFQGFTKINAFNWAKVRKLSFKRKRFLIKLRPDANSAYQDTLEFLMASRDFCKSFWKICVEHHAFFRLFEEPKPKPKPVLFSRGSSFRFSGRTQKQVLDYVKEGGHKKVQFERKHSKIHSIRSLASQPTELNSEVLEQSQQSTSLTFGEGAESPGGQSCRRGKEPKVSAGEPGSHPSPAPRRSPAGNKQADGAASAPTEEEEEVVKDRTQQSKPQPPQPSTGSLTGSPHLSELSVNSQGGVAPANVTLSPNLSPDTKQASPLISPLLNDQACPRTDDEDEGRRKRFPTDKAYFIAKEVSTTERTYLKDLEVITSWFQSTVSKEDAMPEALKSLIFPNFEPLHKFHTNFLKEIEQRLALWEGRSNAQIRDYQRIGDVMLKNIQGMKHLAAHLWKHSEALEALENGIKSSRRLENFCRDFELQKVCYLPLNTFLLRPLHRLMHYKQVLERLCKHHPPSHADFRDCRAALAEITEMVAQLHGTMIKMENFQKLHELKKDLIGIDNLVVPGREFIRLGSLSKLSGKGLQQRMFFLFNDVLLYTSRGLTASNQFKVHGQLPLYGMTIEESEDEWGVPHCLTLRGQRQSIIVAASSRSEMEKWVEDIQMAIDLAEKSSSPAPEFLASSPPDNKSPDEATAADQESEDDLSASRTSLERQAPHRGNTMVHVCWHRNTSVSMVDFSIAVENQLSGNLLRKFKNSNGWQKLWVVFTNFCLFFYKSHQDNHPLASLPLLGYSLTIPSESENIQKDYVFKLHFKSHVYYFRAESEYTFERWMEVIRSATSSASRPHVLSHKESLVY

SEQ ID NO: 9824 - protein, 3222 aa, Homo sapiens
MVTTVVAVGDTLAQPLAAAEVFIVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQYGDFISYCFKEKKCKKVCFTVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 9825 - protein, 2809 aa, Homo sapiens
MTLEGLYLARGPLARLLLAWSALLCMAGGQGRWDGALEAAGPGRVRRRGSPGILQGPNVCGSRFHAYCCPGWRTFPGRSQCVVPICRRACGEGFCSQPNLCTCADGTLAPSCGVSRGSGCSVSCMNGGTCRGASCLCQKGYTGTVCGQPICDRGCHNGGRCIGPNRCACVYGFMGPQCERDYRTGPCFGQVGPEGCQHQLTGLVCTKALCCATVGRAWGLPCELCPAQPHPCRRGFIPNIHTGACQDVDECQAVPGLCQGGSCVNMVGSFHCRCPVGHRLSDSSAACEDYRAGACFSVLFGGRCAGDLAGHYTRRQCCCDRGRCWAAGPVPELCPPRGSNEFQQLCAQRLPLLPGHPGLFPGLLGFGSNGMGPPLGPARLNPHGSDARGIPSLGPGNSNIGTATLNQTIDICRHFTNLCLNGRCLPTPSSYRCECNVGYTQDVRGECIDVDECTSSPCHHGDCVNIPGTYHCRCYPGFQATPTRQACVDVDECIVSGGLCHLGRCVNTEGSFQCVCNAGFELSPDGKNCVDHNECATSTMCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKDSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIDPACARGFARMTGVTCDDVNECESFPGVCPNGRCVNTAGSFRCECPEGLMLDASGRLCVDVRLEPCFLRWDEDECGVTLPGKYRMDVCCCSIGAVWGVECEACPDPESLEFASLCPRGLGFASRDFLSGRPFYKDVNECKVFPGLCTHGTCRNTVGSFHCACAGGFALDAQERNCTDIDECRISPDLCGQGTCVNTPGSFECECFPGYESGFMLMKNCMDVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACADVDECEENPRVCDQGHCTNMPGGHRCLCYDGFMATPDMRTCVDVDECDLNPHICLHGDCENTKGSFVCHCQLGYMVRKGATGCSDVDECEVGGHNCDSHASCLNIPGSFSCRCLPGWVGDGFECHDLDECVSQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVDTRAGNCFLETHDRGDSGISCSAEIGVGVTRASCCCSLGRAWGNPCELCPMANTTEYRTLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMDMRKSVCFRHYNGTCQNELAFNVTRKMCCCSYNIGQAWNRPCEACPTPISPDYQILCGNQAPGFLTDIHTGKPLDIDECGEIPAICANGICINQIGSFRCECPAGFNYNSILLACEDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDNDECSAQPGPCGAHGHCHNTPGSFRCECHQGFTLVSSGHGCEDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 9826 - protein, 436 aa, Homo sapiens
MRRDVNGVTKSRFEMFSNSDEAVINKKLPKELLLRIFSFLDVVTLCRCAQVSRAWNVLALDGSNWQRIDLFDFQRDIEGRVVENISKRCGGFLRKLSLRGCLGVGDNALRTFAQNCRNIEVLNLNGCTKTTDATCTSLSKFCSKLRHLDLASCTSITNMSLKALSEGCPLLEQLNISWCDQVTKDGIQALVRGCGGLKALFLKGCTQLEDEALKYIGAHCPELVTLNLQTCLQITDEGLITICRGCHKLQSLCASGCSNITDAILNALGQNCPRLRILEVARCSQLTDVGFTTLARNCHELEKMDLEECVQITDSTLIQLSIHCPRLQVLSLSHCELITDDGIRHLGNGACAHDQLEVIELDNCPLITDASLEHLKSCHSLERIELYDCQQITRAGIKRLRTHLPNIKVHAYFAPVTPPPSVGGSRQRFCRCCIIL

SEQ ID NO: 9827 - protein, 283 aa, Homo sapiens
MGASVSRGRAARVPAPEPEPEEALDLSQLPPELLLVVLSHVPPRTLLGRCRQVCRGWRALVDGQALWLLILARDHGATGRALLHLARSCQSPARNARPCPLGRFCARRPIGRNLIRNPCGQEGLRKWMVQHGGDGWVVEENRTTVPGAPSQTCFVTSFSWCCKKQVLDLEEEGLWPELLDSGRIEICVSDWWGARHDSGCMYRLLVQLLDANQTVLDKFSAVPDPIPQWNNNACLHVTHVFSNIKMGVRFVSFEHRGQDTQFWAGHYGARVTNSSVIVRVRLS

SEQ ID NO: 9828 - protein, 1061 aa, Homo sapiens
MENLESRLKNAPYFRCEKGTDSIPLCRKCETCVLAWKIFSTKEWFCRINDISQRRFLVGILKQLNSLYLLHYFQNILQTTQGKDFIYNRSRINLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHLLGAASNPEEPWRNSLRCISEMNRLFSGKGDITKPGYDPCNLLVDLDDIRDLSSGFSKYLDFIRYLPIHLSKYILSMLGCMRGFPRHLPSWPSSGVSGSIFFFPGMLDRHTLNKCASVSQHWAAMAQQVKMDLSAHGFIQNQITFLQGSYTRGIDPNYANKVSIPVPKMVDDGKSMRVKHPKWKLRTKNEYNLWTAYQNEETQQVLIEERNVFCGTYNVRILSDTWDQNRVIHYSGGDLIAVSSNRKIHLLDIIQVKAIPVEFRGHAGSVRALFLCEEENFLLSGSYDLSIRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFLNGNCMKVLKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSDDVEKAQKQGQLETPGKLPSHPKKKSWKIPMSPDQFLLTVSALQHAHNSGEFAYPCRPQTEITDVWGPSISYPRKVLNFKGKSIQRAVDRLRLSNPPIDVKRTSIPLEIQKLQPNLKISLHSPRVQSTIPQPMIIRSRFSGSLKGGDQVTSSIERAVCSTGPLTSMQVIKPNRMLAPQVGTATLSLKKERPRIYTALDPFRVNTEFVLLTVKEEKEHQEAKMKEYQARESTGVVDPGKVSKAAWIRKIKGLPIDNFTKQGKTAAPELGQNVFI

SEQ ID NO: 9829 - protein, 422 aa, Homo sapiens
MERKDFETWLDNISVTFLSLTDLQKNETLDHLISLSGAVQLRHLSNNLETLLKRDFLKLLPLELSFYLLKWLDPQTLLTCCLVSKQWNKVISACTEVWQTACKNLGWQIDDSVQDALHWKKVYLKAILRMKQLEDHEAFETSSLIGHSARVYALYYKDGLLCTGSDDLSAKLWDVSTGQCVYGIQTHTCAAVKFDEQKLVTGSFDNTVACWEWSSGARTQHFRGHTGAVFSVDYNDELDILVSGSADFTVKVWALSAGTCLNTLTGHTEWVTKVVLQKCKVKSLLHSPGDYILLSADKYEIKIWPIGREINCKCLKTLSVSEDRSICLQPRLHFDGKYIVCSSALGLYQWDFASYDILRVIKTPEIANLALLGFGDIFALLFDNRYLYIMDLRTESLISRWPLPEYRKSKRGSSFLAGEHPG

SEQ ID NO: 9830 - protein, 181 aa, Homo sapiens
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 9831 - protein, 243 aa, Homo sapiens
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 9832 - protein, 216 aa, Homo sapiens
MGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 9833 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 9834 - protein, 694 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 9835 - protein, 284 aa, Homo sapiens
MTTAHFYCQYCTASLLGKKYVLKDDSPYCVTCYDRVFSNYCEECKKPIESDSKDLCYKDRHWHEGCFKCTKCNHSLVEKPFAAKDERLLCTECYSNECSSKCFHCKRTIMPGSRKMEFKGNYWHETCFVCENCRQPIGTKPLISKESGNYCVPCFEKEFAHYCNFCKKVITSGGITFCDQLWHKECFLCSGCRKDLCEEQFMSRDDYPFCMDCYNHLYANKCVACSKPISGLTGAKFICFQDSQWHSECFNCGKCSVSLVGKGFLTQNKEIFCQKCGSGMDTDI

SEQ ID NO: 9836 - protein, 563 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVCDWCKHIRHTKEYLDFGDGERRLQFCSAKCLNQYKMDIFYKETQANLPAGLCSTLHPPMENKAEGTGVQLLTPDSWNIPLTDARRKAPSPVATAGQSQGPGPSASTTVSPSDTANCSVTKIPTPVPKSIPISETPNIPPVSVQPPASIGPPLGVPPRSPPMVMTNRGPVPLPIFMEQQIMQQIRPPFIRGPPHHASNPNSPLSNPMLPGIGPPPGGPRNLGPTSSPMHRPMLSPHIHPPSTPTMPGNPPGLLPPPPPGAPLPSLPFPPVSMMPNGPMPVPQMMNFGLPSLAPLVPPPTLLVPYPVIVPLPVPIPIPIPIPHVSDSKPPNGSCCRLRNRR

SEQ ID NO: 9837 - protein, 580 aa, Homo sapiens
MESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGGGDPGGGGLFRGCSPLLTHGPGPATSGGATTLPVEEPIVSTDEVIFPLTVSLDRLPPGTPKAKIVVTVWKREIEAPEVRDQGYLRLLQTRSPGETFRGEQSAFKAQVSTLLTLLPPPVLRCRQFTVAGKHLTVLKVLNSSSQEEISIWDIRILPNFNASYLPVMPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 9838 - protein, 528 aa, Homo sapiens
MAAIDEEGGREIGDEVNILVKEQTQLGVKTLMRLLKEPEKERDSDSDFSPLQQTEGCQRRDKHFRHAENPHHPLKTSSRAAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRLWDLGCKCKSNSHSPQTPRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 9839 - protein, 354 aa, Homo sapiens
MLTLPQNFGNIFLGETFSSYISVHNDSNQVVKDILVKADLQTSSQRLNLSASNAAVAELKPDCCIDDVIHHEVKEIGTHILVCAVSYTTQAGEKMYFRKFFKFQVLKPLDVKTKFYNAESDLSSVTDEVFLEAQIQNMTTSPMFMEKVSLEPSIMYNVTELNSVSQAGECVSTFGSRAYLQPMDTRQYLYCLKPKNEFAEKAGIIKGVTVIGKLDIVWKTNLGERGRLQTSQLQRMAPGYGDVRLSLEAIPDTVNLEEPFHITCKITNCSERTMDLVLEMCNTNSIHWCGISGRQLGKLHPSSSLCLALTLLSSVQGLQSISGLRLTDTFLKRTYEYDDIAQVCVVSSAIKVES

SEQ ID NO: 9840 - protein, 141 aa, Homo sapiens
MPVIPALGEAKGEVLPPGDTTTIIPLNWMLKSPPGHFGLLLLLSQQAKNGVMVLAGVTDPEYQDEISLLLHNEGHLKEVKMEGARLGLPGRAESLEHQVQSHLNMIAQSQRTFQKKDAGKAIILSKLTQEQKTKHCMFSLH

SEQ ID NO: 9841 - protein, 497 aa, Homo sapiens
MASPAPPEHAEEGCPAPAAEEQAPPSPPPPQASPAERQQQEEEAQEAGAAEGAGLQVEEAAGRAAAAVTWLLGEPVLWLGCRADELLSWKRPLRSLLGFVAANLLFWFLALTPWRVYHLISVMILGRVIMQIIKDMVLSRTRGAQLWRSLSESWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 9842 - protein, 356 aa, Homo sapiens
MPEGEDFGPGKSWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 9843 - protein, 660 aa, Homo sapiens
MSNFEKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 9844 - protein, 594 aa, Homo sapiens
MGPEARRTTGRRRSCWKRNPSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 9845 - protein, 680 aa, Homo sapiens
MGKSRTKRFKRPQFSPTGDCQAEAAAAANGTGGEEDDGPAAELLEKLQHPSAEVRECACAGLARLVQQRPALPGLARRDAVRRLGPLLLDPSLAVRETAAGALRNLSACGGFEVCDDMVTKDIMTPLVALLKECSAGLDSNEMSLQEKKDQNRNSIENIANETVNVLWNICECSSRAVSIFNKEGCLEIVLKYLSRFPTNVDLAISVAYCLQTVTEDNPELLKSFSATALNMLESALLSPVSSMESLLLKTLVAGTIWNLKDIIPCKSQAEIINALLKILSEVLGMDAGEMVIQMKEAETQRLKTAAEAEEILENTNGDDLIEDDEMEGISHKRRVRRKTFVSDLLPPTDKELRETIALLTAQQTALEIIVNMCCNEDPSDDEWEELSSSDESDAFMENSFSECGGQLFSPLCLSHEVHTALTNYLIPKKIFEKTAFPNSIAVDLCSRNPTWKPLIRKMNTIQCRALFCLQSLVSLLDVEHLGGAAALQTLAQHLSQLLFSQPDFAKHVDFLEAISSALRALLQTMASKNISQCMTPDQLMTLCKAGIHSSNVGVRVNVVSILGITGSVLAKEDGTLETLKNIGCFLLEVTTKDPSLVVAGEALDALFDVFADGKEAERASIQIKLLSALKEFQPVFKMKIRKEGRGNYSTDQLCVLDNVKMNLRRFIAYQETVEKRLTS

SEQ ID NO: 9846 - protein, 131 aa, Homo sapiens
MPNIPGDLESQEAMVAFFNSAGASAQEEQRVCCQPLAHPVASSQKKPEVAAPAPESGGESVFGETHRALQGAMEKLQESTSARGQCQRRSTGRGGHRQAGPGPGGDEGEPAGAAGQVLQLVGDHKEGHGKF

SEQ ID NO: 9847 - protein, 3000 aa, Homo sapiens
MKELELLCSMKEVSFDGNDLENMVLSLREKFLQEVNSLIQKPSHPLAKTKTLVKSLMNRAELLLHVTIAAQSGLTRSISGTPAETPACKSASETKVISHAVRQPVFLRSMSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCRAALPLMSVEDCGNVELPPWSYSVPSLNSEQEDPSDPASKIASLLLAKLADYVVPGCQTVLSPTASEPDTTLTKTSPKNSLKGDKDPGEESEAVDGKLSIFIHKREDQSSHEVLQPLLSSSEGRPFRLGTGANMEKVVKMDRDMTKGGCCEVITEEAAAALRKATKWAQSGLIVSIGPPVESINPETVSGLSTGDKKKTAQTSICRERNSELARTDPVRPFISGHVANSMAAEVIALLHSLLMAPESNAAQIWTTTAEKVLSRALMYIPQLGKYAESILENGSSSGRKLAKLQRIARQAVAALCALGGFKETIKIGSEVQVLGRGISGSIGVVASINEQEGIATVRFPPIDCRKTSQASDTLTIPLSRLCVPRSEALPLHKLSITEKVVQAVQSMLLPQEGSLSIHTSLPATGDGSAPVMAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVNELVQVETYLRSEGVLVRYWYPIDMLERPPAGYRRTATNGLVTLDNTNLQIHRELLRCEAALARLYCRMALLNIFAPKLPHLFTRLFHIPAIRDITLEHLQLLSNQLLAPPLPDGTISSSSILLAQSLQHCIHSQNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVSRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLNVPIESLRLRFALLQSLNTTLETFFLPLVELRQTPMYTHSIAALLKEAKGLIFYDTKVTVMNRVLNATVQRTADHAAPEITLDPLEIVGGEIRASENSYFCQAARQLASVPSSQLCVKLASGGDPTYAFNIRFTGEEVHGTSGSFRHFLWQVCKELQSSSLSLLLLCPSSAVNKNKGKYILTPSPITYGEEQLLHFLGQLLGIAIRADVPLPLDLLPSFWKTLVGEPLDPEQDLQEADILTYNYVKKFESINDETELEALCAEIASQHLATESPDSPNKPCCRFTYLTMTGEEVELCSRGRHILVAWENKDIYAAAIRSLRLRELQNVECVTAVRAGLGSIIPLQLLTMLSPLEMELRTCGLPYINLEFLKAHTMYQVGLMETDQHIEFFWGALEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 9848 - protein, 2999 aa, Homo sapiens
MKELELLCSMKEVSFDGNDLENMVLSLREKFLQEVNSLIQKPSHPLAKTKTLVKSLMNRAELLLHVTIAAQSGLTRSISGTPAETPACKSASETKVISHAVRQPVFLRSMSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCRAALPLMSVEDCGNVELPPWSYSVPSLNSEQEDPSDPASKIASLLLAKLADYVVPGCQTVLSPTASEPDTTLTKTSPKNSLKGDKDPGEESEAVDGKLSIFIHKREDQSSHEVLQPLLSSSEGRPFRLGTGANMEKVVKMDRDMTKGGCCEVITEEAAAALRKATKWAQSGLIVSIGPPVESINPETVSGLSTGDKKKTAQTSICRERNSELARTDPVRPFISGHVANSMAAEVIALLHSLLMAPESNAAQIWTTTAEKVLSRALMYIPQLGKYAESILENGSSSGRKLAKLQRIARQAVAALCALGGFKETIKIGSEVQVLGRGISGSIGVVASINEQEGIATVRFPPIDCRKTSQASDTLTIPLSRLCVPRSEALPLHKLSITEKVVQAVQSMLLPQEGSLSIHTSLPATGDGSAPVMAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVNELVQVETYLRSEGVLVRYWYPIDMLERPPAGYRRTATNGLVTLDNTNLQIHRELLRCEAALARLYCRMALLNIFAPKLPHLFTRLFHIPAIRDITLEHLQLLSNQLLAPPLPDGTISSSSILLAQSLQHCIHSQNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLNVPIESLRLRFALLQSLNTTLETFFLPLVELRQTPMYTHSIAALLKEAKGLIFYDTKVTVMNRVLNATVQRTADHAAPEITLDPLEIVGGEIRASENSYFCQAARQLASVPSSQLCVKLASGGDPTYAFNIRFTGEEVHGTSGSFRHFLWQVCKELQSSSLSLLLLCPSSAVNKNKGKYILTPSPITYGEEQLLHFLGQLLGIAIRADVPLPLDLLPSFWKTLVGEPLDPEQDLQEADILTYNYVKKFESINDETELEALCAEIASQHLATESPDSPNKPCCRFTYLTMTGEEVELCSRGRHILVAWENKDIYAAAIRSLRLRELQNVECVTAVRAGLGSIIPLQLLTMLSPLEMELRTCGLPYINLEFLKAHTMYQVGLMETDQHIEFFWGALEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 9849 - protein, 3000 aa, Homo sapiens; identical to SEQ ID NO: 9847

SEQ ID NO: 9850 - protein, 3000 aa, Homo sapiens; identical to SEQ ID NO: 9847

SEQ ID NO: 9851 - protein, 282 aa, Homo sapiens
MALEAAGGPPEETLSLWKREQARLKAHVVDRDTEAWQRDPAFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 9852 - protein, 202 aa, Homo sapiens
MHSEPGARLVLTLQTLSRALSNLKACWGCNVTFTHAGPFQKSARSCNWCYFSCSGTMCSTTGVSALPKSKFHLSAKCRGICFLLSSHRIVGHLFAGLLRDFLAIYLQAFFPSPKFLGWLCLLKEPVFTKLHSGASVRCLRSYCRPFRTPSQERTLQPLARDSTFFLILFLTLLLLLLPTNSISFFFLFLSFSYSSFPPSLSC

SEQ ID NO: 9853 - protein, 327 aa, Homo sapiens
MQRNAMYLKNVAETACNFQLTQYQISHANQKPYECQICGKPFRKRAHLTQHNRIHTGGKPYECKECGKVFICCSTLIQHKRTHTSEKPYECLECRKTFRRSAHLIRHQRIHTGEKPYKCKQCWKAFASVSDLIDIGKFTLMRDFTNVQNVGRHLTIAQLLFSIREFTLVRSPLNVRNVAKHSIIAQHLLNTRELILMRNLMNVRNVKRLLGKVHILLNIKEFILVRNHMSVSNVGRLSLVFLILIDIREFTLVKNPMNVKNVVELLTIVQLLFNTREFTLVRRLMNISSVGRFLSPVQHLFNIREHILMKNLMNVSNARRPSSIMHI

SEQ ID NO: 9854 - protein, 1009 aa, Homo sapiens
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 9855 - protein, 775 aa, Homo sapiens
MHPGPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 9856 - protein, 375 aa, Homo sapiens
MEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 9857 - protein, 152 aa, Homo sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 9858 - protein, 369 aa, Homo sapiens
MKLEASCGTATSEVPKPEKKTARDAEPSSETRPQEVEAEPRSGSGPEAEAEPLDFVVATERESEEVLAISGGIYGGLDYLPSRYHSWLRDPDRTVVLAKRNGGVIALESVNVIDAGETVLVEGLRVAPWERGKGVAGLLQRFCSQLVKRQHPGVKVARLTRDDQLGPRELKKYRLITKQGILLVRFNASALLAGLGARLAALRTSGTFSPLPTEAVSEAGGDVARLLLSPSVQRDVLPGGTIIQDWQPYRPSESNLRLLAAKGLEWRVDSRARPRVLTLCTRPFPIPHGGDGTWRYLNIDAFGSDGAQVQSQLLWHLQRQAPRLVGLNVMCQLFLEPQLWSQLADFCQVGLGLELVKGYTEQYLLEADI

SEQ ID NO: 9859 - protein, 250 aa, Homo sapiens
MGQGTGKLPPPHLISDLPPQCPMCDPAIFSKLNSVTRATGLAPSPSKDSEGASFSHLLIIFHFSRQPTQKAWTRWWRCWGSYTEALFSVCSLPGQIRKLRHRKVTQDYRGQHREQWNLHLTPGRRNLHDHSTPPQGTGRENNGSSRTKVTFPRVSCCLDLAAVSVLPRRGISMSSGQWQRGRGAPLQCAGWSAGSCQCEDLQQLVYPWSCHQLPEFGAAGATLVVLPCRGSSCLLVSESQLWGCNLKPKA

SEQ ID NO: 9860 - protein, 336 aa, Homo sapiens
MKERKRHLGDTKHFCPVVLKENFILQPGNTEEAAKYREKIYYFSSAEAKEKFLEHPEDYVAHEEPLKAPPLRICLVGPQGSGKTMCGRQLAEKLNIFHIQFEEVLQEKLLLKTEKKVGPEFEEDSENEQAAKQELEELAIQANVKVEEENTKKQLPEVQLTEEEEVIKSSLMENEPLPPEILEVILSEWWLKEPIRSTGFILDGFPRYPEEAQFLGDRGFFPDAAVFIQVDDQDIFDRLLPAQIEKWKLKQKKKLERKKLIKDMKAKIRVDTIAKRRAELILERDKKRREVSSFVFFFKTGSHSVAQGRVQWHNHSSLQPRTPGLKGSSHLSLSKC

SEQ ID NO: 9861 - protein, 321 aa, Homo sapiens
MRRSSGFGGQKGQGPSCSFTGCWCCRGDDVAESDDSPFAQCGYNIQEKHLGKLHRAASRGEVSKVECILSSGSADLDERDKKKRTALHLACANGHPEVVALLVDRGCQLDVFDNKNRTALLKAVQCQEEECATILLEHGADPDLPDVYGNTTLHYAIYNEDIPMTKKLLLHHANIESANKDELTPFLLAVHEQKQQMEDFLRKQKENLTAVKLESIHQVMSEYKENETPRNPQNSNPEGTSNKMACLGEGAAGAKVDEIPGNPVTRLFNKPSIDDSRPMSANEDFDFDTEEKATEPANGKRQNGMGIIESAPQEHTNNENI

SEQ ID NO: 9862 - protein, 922 aa, Homo sapiens
MHWLASATQTSASIVSSSLLSAVDVSSSLTMSEYFQNTSLPGTANSRQFSLPVVSNAAFLTGSISNFSRASAPAISSAWLQPSASGTSFQPLMGSAYLYQHSSTTMLSGVTGQSHICTSAASYPGVFEWDSTASTVKKSSSLRDFTVTVIDQNTAVSSMSMTAQYYKTSDTNTMVPLYPSLSASLVQGTLTQIPNQQGHNLSLPCQIGSQVYYYNQGTLGPQLSCLQSYGSVSYTGYRASAHQPEMVMVLKEVQPTNVLPPVSTSGMYYSVSSQPITETSVQVMETSLGMDTSLGLQSPSQTFCLPQTPEFSKSFSSRNTQTLESNPSPELGDISITPVQSPTNLLTLSPAPSQEKNENENLDEIKTNLSKPLDVHQILIGNQDPPLLPVEIPDIHPLLACIDPLGQEEQPGSENANLRNKSLSLEDQGIFENGIESSSDLADITTWVEDTYLPPIFSSLQDLDQPESPSAKKAKDTSAIKVNQVQEKSCVIKGHSDQVRKNKHKASEPIQGAPKAKIQPKNPECLLEREVVVGSATVSNSASVNKAKHSSNKPHKAASSRISKTKSHGQEKTKGNRKNSSKKSEESKQSGKKVKVEEKQTIPNMKRKKNQPELSQKTLKKPRSSLGMHMLESVQVFHALGKKIDMKTGFSSSRTLGSSSNTQNRQPFPALKPWLDIQHEGKGPEKIQVKAQKLDGSAEKECTSPSHSELPPPGKVKLIPLPFLTLDQPQARHVSRRPNPLASRRPAVAYPARPDSTNSAQSNAVNPSRPAPTNTSLTGPATPAQPISAKATQPSSANPTQPTVPQSAASRPSAYKTSSCSSLQREPVSTAVTSLRSLPKPQNQFLIQDFSLQPRPWRKPTVPEPVMSTPITEEQRPEREAMKRKAQQERENAAKYTSLGKVQFFIERERDMEIAEYYGYTI

SEQ ID NO: 9863 - protein, 922 aa, Homo sapiens; identical to SEQ ID NO: 9862

SEQ ID NO: 9864 - protein, 1865 aa, Homo sapiens
MHSIRTVEIKVPEIEETFFAPRFSEEPRGGRGGGGGGRGARPELRSAQPLVGAALCTEHVRAPPAPSRSRSRSDGSHGSRRALCKAAADASGASRARVGLPSQRLPPPPPDSPGRLPRPGPGAEEGRDGLSARGAAAQQRDCTMGNQDGKLKRSAGDALHEGGGGAEDALGPRDVEATKKGSGGKKALGKHGKGGGGGGGGGESGKKKSKSDSRASVFSNLRIRKNLSKGKGAGGSREDVLDSQALQTGELDSAHSLLTKTPDLSLSADEAGLSDTECADPFEVTGPGGPGPAEARVGGRPIAEDVETAAGAQDGQRTSSGSDTDIYSFHSATEQEDLLSDIQQAIRLQQQQQQQLQLQLQQQQQQQQLQGAEEPAAPPTAVSPQPGAFLGLDRFLLGPSGGAGEAPGSPDTEQALSALSDLPESLAAEPREPQQPPSPGGLPVSEAPSLPAAQPAAKDSPSSTAFPFPEAGPGEEAAGAPVRGAGDTDEEGEEDAFEDAPRGSPGEEWAPEVGEDAPQRLGEEPEEEAQGPDAPAAASLPGSPAPSQRCFKPYPLITPCYIKTTTRQLSSPNHSPSQSPNQSPRIKRRPEPSLSRGSRTALASVAAPAKKHRADGGLAAGLSRSADWTEELGARTPRVGGSAHLLERGVASDSGGGVSPALAAKASGAPAAADGFQNVFTGRTLLEKLFSQQENGPPEEAEKFCSRIIAMGLLLPFSDCFREPCNQNAQTNAASFDQDQLYTWAAVSQPTHSLDYSEGQFPRRVPSMGPPSKPPDEEHRLEDAETESQSAVSETPQKRSDAVQKEVVDMKSEGQATVIQQLEQTIEDLRTKIAELERQYPALDTEVASGHQGLENGVTASGDVCLEALRLEEKEVRHHRILEAKSIQTSPTEEGGVLTLPPVDGLPGRPPCPPGAESGPQTKFCSEISLIVSPRRISVQLDSHQPTQSISQPPPPPSLLWSAGQGQPGSQPPHSISTEFQTSHEHSVSSAFKNSCNIPSPPPLPCTESSSSMPGLGMVPPPPPPLPGMTVPTLPSTAIPQPPPLQGTEMLPPPPPPLPGAGIPPPPPLPGAGILPLPPLPGAGIPPPPPLPGAAIPPPPPLPGAGIPLPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGAGIPPPPPLPGVGIPPPPPLPGAGIPPPPPLPGAGIPPPPPLPGAGIPPPPPLPRVGIPPPPPLPGAGIPPPPPLPGAGIPPPPPLPGVGIPPPPPLPGVGIPPPPPLPGAGIPPPPPLPGMGIPPAPAPPLPPPGTGIPPPPLLPVSGPPLLPQVGSSTLPTPQVCGFLPPPLPSGLFGLGMNQDKGSRKQPIEPCRPMKPLYWTRIQLHSKRDSSTSLIWEKIEEPSIDCHEFEELFSKTAVKERKKPISDTISKTKAKQVVKLLSNKRSQAVGILMSSLHLDMKDIQHAVVNLDNSVVDLETLQALYENRAQSDELEKIEKHGRSSKDKENAKSLDKPEQFLYELSLIPNFSERVFCILFQSTFSESICSIRRKLELLQKLCETLKNGPGVMQVLGLVLAFGNYMNGGNKTRGQADGFGLDILPKLKDVKSSDNSRSLLSYIVSYYLRNFDEDAGKEQCLFPLPEPQDLFQASQMKFEDFQKDLRKLKKDLKACEVEAGKVYQVSSKEHMQPFKENMEQFIIQAKIDQEAEENSLTETHKCFLETTAYFFMKPKLGEKEVSPNAFFSIWHEFSSDFKDFWKKENKLLLQERVKEAEEVCRQKKGKSLYKIKPRHDSGIKAKISMKT

SEQ ID NO: 9865 - protein, 940 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKKQNKRMKPARSRRR

SEQ ID NO: 9866 - protein, 889 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMYSTLPGRRALKNSRLVSQKDDVHVCILCLRAIMNYQYGFNLVMSHPHAVNEIALSLNNKNPRTKALVLELLAAVCLVRGGHEIILAAFDNFKEVCKELHRFEKLMEYFRNEDSNIDFMVACMQFINIVVHSVEDMNFRVHLQYEFTKLGLEEFLQKSRHTESEKLQVQIQAYLDNVFDVGGLLEDAETKNVALEKVEELEEHVSHLTEKLLDLENENMMRVAELEKQLLQREKELESIKETYENTSHQVHTLRRLIKEKEEAFQRRCHLEPNVRGLESVDSEALARVGPAELSEGMPPSDLDLLAPAPPPEEVLPLPPPPAPPLPPPPPPLPDKCPPAPPLPGAAPSVVLTVGLSAIRIKKPIKTKFRLPVFNWTALKPNQISGTVFSELDDEKILEDLDLDKFEELFKTKAQGPALDLICSKNKTAQKAASKVTLLEANRAKNLAITLRKAGRSAEEICRAIHTFDLQTLPVDFVECLMRFLPTEAEVKLLRQYERERQPLEELAAEDRFMLLFSKVERLTQRMAGMAFLGNFQDNLQMLTPQLNAIIAASASVKSSQKLKQMLEIILALGNYMNSSKRGAVYGFKLQSLDLLLDTKSTDRKMTLLHFIALTVKEKYPDLANFWHELHFVEKAAAVSLENVLLDVKELGRGMELIRRECSIHDNSVLRNFLSTNEGKLDKLQRDAKTAEEAYNAVVRYFGESPKTTPPSVFFPVFVRFIRSYKKQNKRMKPARSRRR

SEQ ID NO: 9867 - protein, 500 aa, Homo sapiens
MALSDSSELTCSTTFSSCTISSLQCGTEYLISVLASNDAGSSKSSSAMTLKTVACAPGRVTIQEDPPGHLSVAWSNVDLGDYYVVFVKSDDGLEVHCNTSLTQCNFLSECGFTYFISVFAYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 9868 - protein, 489 aa, Homo sapiens [sequence omitted]

SEQ ID NO: 9869 - protein, 486 aa, Homo sapiens
MIRRVLPHGMGRGLLTRRPGTRRGGFSLDWDGKVSEIKKKIKSILPGRSCDLLQDTSHLPPEHSDVVIVGGGVLGLSVAYWLKKLESRRGAIRVLVVERDHTYSQASTGLSVGGICQQFSLPENIQLSLFSASFLRNINEYLAVVDAPPLDLRFNPSGYLLLASEKDAAAMESNVKVQRQEGAKVSLMSPDQLRNKFPWINTEGVALASYGMEDEGWFDPWCLLQGLRRKVQSLGVLFCQGEVTRFVSSSQRMLTTDDKAVVLKRIHEVHVKMDRSLEYQPVECAIVINAAGAWSAQIAALAGVGEGPPGTLQGTKLPVEPRKRYVYVWHCPQGPGLETPLVADTSGAYFRREGLGSNYLGGRSPTEQEEPDPANLEVDHDFFQDKVWPHLALRVPAFETLKVQSAWAGYYDYNTFDQNGVVGPHPLVVNMYFATGFSGHGLQQAPGIGRAVAEMVLKGRFQTIDLSPFLFTRFYLGEKIQENNII

SEQ ID NO: 9870 - protein, 3169 aa, Homo sapiens
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 9871 - protein, 278 aa, Homo sapiens
MGKGNEDSDLHCSSIQCSTDQPPFQQISFTEKGSDEKKPFKEKGKTAFSHSSEKHIQRQGSEPNPNKENSEETKLKAGNSTAGSEPESSSYRENCRKRKMSSKDSCQDTAGNCPEKECSLSLNKKSRSSTAVHNSEIQETCDAHHRGHSRACTGHSKRHRSRALGVQTPSIRKSLVTSVRAMSEAVYQDLAQVWAQQIHSPLTCEQLTLLTRLRGPLCAQVQTLYSMATQAAYVFPAESWLVPATLPGPGESALDREAHPFPGQEITETVSGSDEAKL

SEQ ID NO: 9872 - protein, 1039 aa, Homo sapiens
MAVQLVPDSALGLLMMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQECHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 9873 - protein, 292 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKPEEQHNKSVHVAGLSWVKPGSVQPFSKEEKTVAT

SEQ ID NO: 9874 - protein, 292 aa, Homo sapiens; identical to SEQ ID NO: 9873

SEQ ID NO: 9875 - protein, 644 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQSRSVMTEEYKVPDGMVGFIIGRGGEQISRIQQESGCKIQIAPDSGGLPERSCMLTGTPESVQSAKRLLDQIVEKGRPAPGFHHGDGPGNAVQEIMIPASKAGLVIGKGGETIKQLQERAGVKMVMIQDGPQNTGADKPLRITGDPYKVQQAKEMVLELIRDQGGFREVRNEYGSRIGGNEGIDVPIPRFAVGIVIGRNGEMIKKIQNDAGVRIQFKPDDGTTPERIAQITGPPDRCQHAAEIITDLLRSVQAGNPGGPGPGGRGRGRGQGNWNMGPPGGLQEFNFIVPTGKTGLIIGKGGETIKSISQQSGARIELQRNPPPNADPNMKLFTIRGTPQQIDYARQLIEEKIGGPVNPLGPPVPHGPHGVPGPHGPPGPPGPGTPMGPYNPAPYNPGPPGPAPHGPPAPYAPQGWGNAYPHWQQQAPPDPAKAGTDPNSAAWAAYYAHYYQQQAQPPPAAPAGAPTTTQTNGQGDQQNPAPAGQVDYTKAWEEYYKKMGQAVPAPTGAPPGGQPDYSAAWAEYYRQQAAYYAQTSPQGMPQHPPAPQGQ

SEQ ID NO: 9876 - protein, 95 aa, Homo sapiens
MELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 9877 - protein, 473 aa, Homo sapiens [sequence omitted]

SEQ ID NO: 9878 - protein, 473 aa, Homo sapiens
MCSGLLELLLPIWLSWTLGTRGSEPRSVNDPGNMSFVKETVDKLLKGYDIRLRPDFGGPPVCVGMNIDIASIDMVSEVNMDYTLTMYFQQYWRDKRLAYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGGDKAVTGVERIELPQFSIVEHRLVSRNVVFATGAYPRLSLSFRLKRNIGYFILQTYMPSILITILSWVSFWINYDASAARVALGITTVLTMTTINTHLRETLPKIPYVKAIDMYLMGCFVFVFLALLEYAFVNYIFFGRGPQRQKKLAEKTAKAKNDRSKSESNRVDAHGNILLTSLEVHNEMNEVSGGIGDTRNSAISFDNSGIQYRKQSMPREGHGRFLGDRSLPHKKTHLRRRSSQLKIKIPDLTDVNAIDRWSRIVFPFTFSLFNLVYWLYYVN

SEQ ID NO: 9879 - protein, 447 aa, Homo sapiens
MPVLYDRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 9880 - protein, 458 aa, Homo sapiens
MATESPATRRVQVAEHPRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVLRLEEVQAKLGISLEEMLLVTEDALHPEPYNPEEICRCLGISLEELRTQILSPNTQDVLIFKLYQRAKHVYSEAARVLQFKKICEEAPENMVQLLGELMNQSHMSCRDMYECSCPELDQLVDICRKFGAQGSRLTGAGWGGCTVSMVPADKLPSFLANVHKAYYQRSDGSLAPEKQSLFATKPGGGALVLLEA

SEQ ID NO: 9881 - protein, 593 aa, Homo sapiens
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTTLPHMLMSQRVIAPNPAQLQGQRGPPKPGLVRTTTPNMNPAINYQPQSSSSVPCQRTTSSAIYMNLASHIQPGTVNRVSSPLPSPSAMTDAANSQAAAKLALRKQLEKTLLEIPPPKPPAPLLHFLPSAANSEFIYMVGLEEVVQSVIDSQGKSCASLLRVEPFVCAQCRTDFTPHWKQEKNGKILCEQCMTSNQKKALKAEHTNRLKNAFVKALQQEQEIEQRLQQQAALSPTTAPAVSSVSKQETIMRHHTLRQAPQPQSSLQRGIPTSARSMLSNFAQAPQLSVPGGLLGMPGVNIAYLNTGIGGHKGPSLADRQREYLLDMIPPRSISQSISGQK

SEQ ID NO: 9882 - protein, 180 aa, Homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 9883 - protein, 173 aa, Homo sapiens
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 9884 - protein, 367 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 9885 - protein, 465 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDVFQQVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 9886 - protein, 460 aa, Homo sapiens
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 9887 - protein, 515 aa, Homo sapiens
MGSLSSRVLRQPRPALAQQAQGARAGGSARRPDTGDDAAGHGFCYCAGSHKRKRSSGSFCYCHPDSETDEDEEEGDEQQRLLNTPRRKKLKSTSKYIYQTLFLNGENSDIKICALGEEWSLHKIYLCQSGYFSSMFSGSWKESSMNIIELEIPDQNIDVEALQVAFGSLYRDDVLIKPSRVVAILAAACLLQLDGLIQQCGETMKETVNVKTVCGYYTSAGTYGLDSVKKKCLEWLLNNLMTHQNVELFKELSINVMKQLIGSSNLFVMQVEMDIYTALKKWMFLQLVPSWNGSLKQLLTETDVWFSKQRKDFEGMAFLETEQGKPFVSVFRHLRLQYIISDLASARIIEQDAVVPSEWLSSVYKQQWFAMLRAEQDSEVGPQEINKEELEGNSMRCGRKLAKDGEYCWRWTGFNFGFDLLVTYTNRYIIFKRNTLNQPCSGSVSLQPRRSIAFRLRLASFDSSGKLICSRTTGYQILTLEKDQEQVVMNLDSRLLIFPLYICCNFLYISPEKKN

SEQ ID NO: 9888 - protein, 340 aa, Homo sapiens [sequence omitted]

SEQ ID NO: 9889 - protein, 1256 aa, Homo sapiens
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 9890 - protein, 767 aa, Homo sapiens
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRDHVIASKTGAESKITALEQKEQELQALIQQLSIDLQKVTAETQEKEDVITHLQEKVASLEKRLEQNLSGEEHVQELLKEKTLAEQNLEDTRQQLLAARSSQAKAINTLETRVRELEQTLQASEEQLQQSKGIVAAQETQIQELAAANQESSHVQQQALALEQQFLERTQALEAQIVALERTRAADQTTAEQGMRQLEQENAALKECRNEYERSLQNHQFELKKLKEEWSQREIVSVAMAQALEEVRKQREEFQQQAANLTAIIDEKEQNLREKTEVLLQKEQEILQLERGHNSALLQIHQLQAELEALRTLKAEEAAVVAEQEDLLRLRGPLQAEALSVNESHVTSRAMQDPVFQLPTAGRTPNGEVGAMDLTQLQKEKQDLEQQLLEKNKTIKQMQQRMLELRKTLQKELKIRPDNELFEVREKPGPEMANMAPSVTNNTDLTDAREINFEYLKHVVLKFMSCRESEAFHLIKAVSVLLNFSQEEENMLKETLEYKMSWFGSKPAPKGSIRPSISNPRIPWS

SEQ ID NO: 9891 - protein, 185 aa, Homo sapiens
MFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 9892 - protein, 248 aa, Homo sapiens
MAAGTSSYWEDLRKQARQLENELDLKLVSFSKLCTSYSHSSTRDGRRDSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 9893 - protein, 250 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 9894 - protein, 473 aa, Homo sapiens
MAQHDFAPAWLNFPTPPSSTKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFPSLNPEYEREPNHNKSLAAGVWEYPPNPKSRAPRMLVIKKGNTKDLQLSGFPVVGNLPSQPVKNGTGPSVYKGLVPKPAAPPTKPTQWKSQTKENKVGTSFPHESTFGVGNFNAFKSTAKNFSPSTNSVKECNRSNSSSPVDKLNQQPRLTKLTRMRTDKKSEFLKALKRDRVEEEHEDESRAGSEKDDDSFNLHNSNSTHQERDINRNFDENEIPQENGNASVISQQIIRSSTFPQTDVLSSSLEAEHRLLKEMGWQEDSENDETCAPLTEDEMREFQVISEQLQKNGLRKNGILKNGLICDFKFGPWKNSTFKPTTENDDTETSSSDTSDDDDV

SEQ ID NO: 9895 - protein, 609 aa, Homo sapiens
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADHRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 9896 - protein, 693 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 9897 - protein, 687 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 9898 - protein, 687 aa, Homo sapiens; identical to SEQ ID NO: 9897

SEQ ID NO: 9899 - protein, 308 aa, Homo sapiens [sequence omitted]

SEQ ID NO: 9900 - protein, 523 aa, Homo sapiens
MQRAAALVRRGCGPRTPSSWGRSQSSAAAEASAVLKVRPERSRRERILTLESMNPQVKAVEYAVRGPIVLKAGEIELELQRGIKKPFTEVIRANIGDAQAMGQQPITFLRQVMALCTYPNLLDSPSFPEDAKKRARRILQACGGNSLGSYSASQGVNCIREDVAAYITRRDGGVPADPDNIYLTTGASDGISTILKILVSGGGKSRTGVMIPIPQYPLYSAVISELDAIQVNYYLDEENCWALNVNELRRAVQEAKDHCDPKVLCIINPGNPTGQVQSRKCIEDVIHFAWEEKLFLLADEVYQDNVYSPDCRFHSFKKVLYEMGPEYSSNVELASFHSTSKGYMGECGYRGGYMEVINLHPEIKGQLVKLLSVRLCPPVSGQAAMDIVVNPPVAGEESFEQFSREKESVLGNLAKKAKLTEDLFNQVPGIHCNPLQGAMYAFPRIFIPAKAVEAAQAHQMAPDMFYCMKLLEETGICVVPGSGFGQREGTYHFRMTILPPVEKLKTVLQKVKDFHINFLEKYA

SEQ ID NO: 9901 - protein, 197 aa, Homo sapiens
  MOD_RES 73: Xaa = Selenocysteine
MSLGRLCRLLKPALLCGALAAPGLAGTMCASRDDWRCARSMHEFSAKDIDGHMVNLDKYRGFVCIVTNVASQXGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 9902 - protein, 548 aa, Homo sapiens
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 9903 - protein, 536 aa, Homo sapiens
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 9904 - protein, 536 aa, Homo sapiens; identical to SEQ ID NO: 9903

SEQ ID NO: 9905 - protein, 594 aa, Homo sapiens
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 9906 - protein, 168 aa, Homo sapiens
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 9907 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDSIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 9908 - protein, 883 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 9909 - protein, 885 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQQYHPTDITGPLNLSDPSVSTVV

SEQ ID NO: 9910 - protein, 938 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 9911 - protein, 901 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQSTGGGRGALQNQKDTVLPRRAIEREEGQLQLCSRHRES

SEQ ID NO: 9912 - protein, 1484 aa, Homo sapiens
MKPRAECCSPKFWLVLAVLAVSGSRARSQKSPPSIGIAVILVGTSDEVAIKDAHEKDDFHHLSVVPRVELVAMNETDPKSIITRICDLMSDRKIQGVVFADDTDQEAIAQILDFISAQTLTPILGIHGGSSMIMADKDESSMFFQFGPSIEQQASVMLNIMEEYDWYIFSIVTTYFPGYQDFVNKIRSTIENSFVGWELEEVLLLDMSLDDGDSKIQNQLKKLQSPIILLYCTKEEATYIFEVANSVGLTGYGYTWIVPSLVAGDTDTVPAEFPTGLISVSYDEWDYGLPARVRDGIAIITTAASDMLSEHSFIPEPKSSCYNTHEKRIYQSNMLNRYLINVTFEGRNLSFSEDGYQMHPKLVIILLNKERKWERVGKWKDKSLQMKYYVWPRMCPETEEQEDDHLSIVTLEEAPFVIVESVDPLSGTCMRNTVPCQKRIVTENKTDEEPGYIKKCCKGFCIDILKKISKSVKFTYDLYLVTNGKHGKKINGTWNGMIGEVVMKRAYMAVGSLTINEERSEVVDFSVPFIETGISVMVSRSNGTVSPSAFLEPFSADVWVMMFVMLLIVSAVAVFVFEYFSPVGYNRCLADGREPGGPSFTIGKAIWLLWGLVFNNSVPVQNPKGTTSKIMVSVWAFFAVIFLASYTANLAAFMIQEEYVDQVSGLSDKKFQRPNDFSPPFRFGTVPNGSTERNIRNNYAEMHAYMGKFNQRGVDDALLSLKTGKLDAFIYDAAVLNYMAGRDEGCKLVTIGSGKVFASTGYGIAIQKDSGWKRQVDLAILQLFGDGEMEELEALWLTGICHNEKNEVMSSQLDIDNMAGVFYMLGAAMALSLITFICEHLFYWQFRHCFMGVCSGKPGMVFSISRGIYSCIHGVAIEERQSVMNSPTATMNNTHSNILRLLRTAKNMANLSGVNGSPQSALDFIRRESSVYDISEHRRSFTHSDCKSYNNPPCEENLFSDYISEVERTFGNLQLKDSNVYQDHYHHHHRPHSIGSASSIDGLYDCDNPPFTTQSRSISKKPLDIGLPSSKHSQLSDLYGKFSFKSDRYSGHDDLIRSDVSDISTHTVTYGNIEGNAAKRRKQQYKDSLKKRPASAKSRREFDEIELAYRRRPPRSPDHKRYFRDKEGLRDFYLDQFRTKENSPHWEHVDLTDIYKERSDDFKRDSISGGGPCTNRSHIKHGTGDKHGVVSGVPAPWEKNLTNVEWEDRSGGNFCRSCPSKLHNYSTTVTGQNSGRQACIRCEACKKAGNLYDISEDNSLQELDQPAAPVAVTSNASTTKYPQSPTNSKAQKKNRNKLRRQHSYDTFVDLQKEEAALAPRSVSLKDKGRFMDGSPYAHMFEMSAGESTFANNKSSVPTAGHHHHNNPGGGYMLSKSLYPDRVTQNPFIPTFGDDQCLLHGSKSYFFRQPTVAGASKARPDFRALVTNKPVVSALHGAVPARFQKDICIGNQSNPCVPNNKNPRAFNGSSNGHVYEKLSSIESDV

SEQ ID NO: 9913 - protein, 165 aa, Homo sapiens
MLCGLSRETPGEADDGPYSKGGKDAGGADVSLACRRQSIPEEFRGITVVELIKKEGSTLGLTISGGTDKDGKPRVSNLRPGGLAARSDLLNIGDYIRSVNGIHLTRLRHDEIITLLKNVGERVVLEVEYELPPPAPENNPRIISKTVDVSLYKEGNSFGFVLRGQ

SEQ ID NO: 9914 - protein, 1194 aa, Homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPPHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 9915 - protein, 915 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 9916 - protein, 922 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNCIPPVRKSVQKSVTWYTIPPTV

SEQ ID NO: 9917 - protein, 913 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNFFFWLYSGTWITL

SEQ ID NO: 9918 - protein, 908 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYANKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 9919 - protein, 438 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCRDNRQGWACCPYRQGVCCADRRHCCPAGFRCAARGTKCLRREAPRWDAPLRDPALRQLL

SEQ ID NO: 9920 - protein, 225 aa, Homo sapiens
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 9921 - protein, 257 aa, Homo sapiens
MDQNPGYYHQLLQGERNPRLEDAIRTDLNRTFPDNVKFRKTTDPCLQRTLYNVLLAYGHHNQGVGYCQGMNFIAGYLVLITNNEEESFWLLDALVGRILPDYYSPAMLGLKTDQEVLGELVRAKLPAVGALMERLGVLWTLLVSRWFICLFVDILPVETVLRIWDCLFNEGSKIIFRVALTLIKQHQELILEATSVPDICDKFKQITKGSFVMECHTFMQVCGAARGSVPSQGAPPHLQPGGCSDHPEGAQDGHQWA

SEQ ID NO: 9922 - protein, 394 aa, Homo sapiens
MFSVFEEITRIVVKEMDAGGDMIAVRSLVDADRFRCFHLVGEKRTFFGCRHYTTGLTLMDILDTHGDKWLDELDSGLQGQKAEFQILDNVDSTGELIVRLPKEITISGSFQGFHHQKIKISENRISQQYLATLENRKLKRELPFSFRSINTRENLYLVTETLETVKEETLKSDRQYKFWSQISQGHLSYKHKGQREVTIPPNRVLSYRVKQLVFPNKETMRKSLGSEDSRNMKEKLEDMESVLKDLTEEKRKDVLNSLAKCLGKEDIRQDLEQRVSEVLISGELHMEDPDKPLLSSLFNAAGVLVEARAKAILDFLDALLELSEEQQFVAEALEKGTLPLLKDQVKSVMEQNWDELASSPPDMDYDPEARILCALYVVVSILLELAEGPTSVSS

SEQ ID NO: 9923 - protein, 109 aa, Homo sapiens
MAYQLYRNTTLGNSLQESLDELIQSQQITPQLALQVLLQFDKAINAALAQRVRNRVNFRGSLNTYRFCDNVWTFVLNDVEFREVTELIKVDKVKIVACDGKNTGSNTTE

SEQ ID NO: 9924 - protein, 944 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIVDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 9925 - protein, 959 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 9926 - protein, 423 aa, Homo sapiens
MRSSGADAGRCLVTARAPGSVPASREGSAGSRGPGARFPARVSARGSAPGPGLGGAGALDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQNTNEPLFKCTQEGCGKHFASPSKLKRHAKAHEGYVCQKGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKREFGLSSQWIYPPKRKQGQGLSLCQNGESPNCVEDKMLSTVAVLTLG

SEQ ID NO: 9927 - protein, 732 aa, Homo sapiens
MSRRKISSESFSSLGSDYLETSPEEEGECPLSRLCWNGSRSPPGPLEPSPAAAAAAAAPAPTPAASAAAAAATAGARRVQRRRRVNLDSLGESISRLTAPSPQTIQQTLKRTLQYYEHQVIGYRDAEKNFHNISNRCSYADHSNKEEIEDVSGILQCTANILGLKFEEIQKRFGEEFFNICFHENERVLRAVGGTLQDFFNGFDALLEHIRTSFGKQATLESPSFLCKELPEGTLMLHYFHPHHIVGFAMLGMIKAAGKKIYRLDVEVEQVANEKLCSDVSNPGNCSCLTFLIKECENTNIMKNLPQGTSQVPADLRISINTFCRAFPFHLMFDPSMSVLQLGEGLRKQLRCDTHKVLKFEDCFEIVSPKVNATFERVLLRLSTPFVIRTKPEASGSENKDKVMEVKGQMIHVPESNSILFLGSPCVDKLDELMGRGLHLSDIPIHDATRDVILVGEQAKAQDGLKKRMDKLKATLERTHQALEEEKKKTVDLLYSIFPGDVAQQLWQGQQVQARKFDDVTMLFSDIVGFTAICAQCTPMQVISMLNELYTRFDHQCGFLDIYKVETIGDAYCVAAGLHRKSLCHAKPIALMALKMMELSEEVLTPDGRPIQMRIGIHSGSVLAGVVGVRMPRYCLFGNNVTLASKFESGSHPRRINVSPTTYQLLKREESFTFIPRSREELPDNFPKEIPGICYFLEVRTGPKPPKPSLSSSRIKKVSYNIGTMFLRETSL

SEQ ID NO: 9928 - protein, 690 aa, Homo sapiens
MFCTKLKDLKITGECPFSLLAPGQVPNESSEEAAGSSESCKATVPICQDIPEKNIQESLPQRKTSRSRVYLHTLAESICKLIFPEFERLNVALQRTLAKHKIKESRKSLEREDFEKTIAEQAVAAGVPVEVIKESLGEEVFKICYEEDENILGVVGGTLKDFLNSFSTLLKQSSHCQEAGKRGRLEDASILCLDKEDDFLHVYYFFPKRTTSLILPGIIKAAAHVLYETEVEVSLMPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRLLKDCPGFVFTPRSREELPPNFPSEIPGICHFLDAYQQGTNSKPCFQKKDVEDGNANFLGKASGID

SEQ ID NO: 9929 - protein, 669 aa, Homo sapiens
MWTLVGRGWGCARALAPRATGAALLVAPGPRSAPTLGAAPESWATDRLYSSAEFKEKPDMSRFPVENIRNFSIVAHVDHGKSTLTDRLLELTGTIDKTKNNKQVLDKLQVERERGITVKAQTASLFYNCEGKQYLLNLIDTPGHVDFSYEVSRSLSACQGVLLVVDANEGIQAQTVANFFLAFEAQLSVIPVINKIDLKNADPERVENQIEKVFDIPSDECIKISAKLGTNVESVLQAIIERIPPPKVHRKNPLRALVFDSTFDQYRGVIANVALFDGVVSKGDKIVSAHTQKTYEVNEVGVLNPNEQPTHKLYAGQVGYLIAGMKDVTEAQIGDTLCLHKQPVEPLPGFKSAKPMVFAGMYPLDQSEYNNLKSAIEKLTLNDSSVTVHRDSSLALGAGWRLGFLGLLHMEVFNQRPEQEYNASVILTTPTVPYKAVLSSSKLIKEHREKEITIINPAQFPDKSKVTEYLEPVVLGTIITPDEYTGKIMMLCEARRAVQKNMIFIDQNRVMLKYLFPLNEIVVDFYDSLKSLSSGYASFDYEDAGYQTAELVKMDILLNGNTVEELVTVVHKDKAHSIGKAICERLKDSLPRQLFEIAIQAAIGSKIIARETVKAYRKNVLAKCCGGDITRKMKLLKRQAEGKKKLRKIGNVEVPKDAFIKVLKTQSSK

SEQ ID NO: 9930 - protein, 304 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 9931 - protein, 909 aa, Homo sapiens
MERAMEQLNRLTRSLRHARTVELPEDNETAVYTLMPMVMADQHRSVSELLSNSKFDVNYAFGRVKRSLLHIAANCGSVECLVLLLKKGANPNYQDISGCTPLHLAARNGQKKCMSKLLEYSADVNICNNEGLTAIHWLAVNGRTELLHDLVQHVSDVDVEDAMGQTALHVACQNGHKTTVQCLLDSGADINRPNVSGATPLYFACSHGQRDTAQILLLRGAKYLPDKNGVTPLDLCVQGGYGETCEVLIQYHPRLFQTIIQMTQNEDLRENMLRQVLEHLSQQSESQYLKILTSLAEVATTNGHKLLSLSSNYDAQMKSLLRIVRMFCHVFRIGPSSPSNGIDMGYNGNKTPRSQVFKPLELLWHSLDEWLVLTATELMKNKRDSTEITSILLKQKGQDQDAASIPPFEPPGPGSYENLSTGTRESKPDALAGRQEASADCQDVISMTANRLSAVIQAFYMCCSCQMPPGMTSPRFIEFVCKHDEVLKCFVNRNPKIIFDHFHFLLECPELMSRFMHIIKAQPFKDRCEWFYEHLHSGQPDSDMVHRPVNENDILLVHRDSIFRSSCEVVSKANCAKLKQGIAVRFHGEEGMGQGVVREWFDILSNEIVNPDYALFTQSADGTTFQPNSNSYVNPDHLNYFRFAGQILGLALNHRQLVNIYFTRSFYKHILGIPVNYQDVASIDPEYAKNLQWILDNDISDLGLELTFSVETDVFGAMEEVPLKPGGGSILVTQNNKAEYVQLVTELRMTRAIQPQINAFLQGFHMFIPPSLIQLFDEYELELLLSGMPEIDVSDWIKNTEYTSGYEREDPVIQWFWEVVEDITQEERVLLLQFVTGSSRVPHGGFANIMGGSGLQNFTIAAVPYTPNLLPTSSTCINMLKLPEYPSKEILKDRLLVALHCGSYGYTMA

SEQ ID NO: 9932 - protein, 129 aa, Homo sapiens
MSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPNIKGTCGCGESFNI

SEQ ID NO: 9933 - protein, 615 aa, Homo sapiens
MVSGPLALRWCAWAGRGDMGPDMELPSHSKQLLLQLNQQRTKGFLCDVIIMVENSIFRAHKNVLAASSIYFKSLVLHDNLINLDTDMVSSTVFQQILDFIYTGKLLPSDQPAEPNFSTLLTAASYLQLPELAALCRRKLKRAGKPFGSGRAGSTGMGRPPRSQRLSTASVIQARYQGLVDGRKGAHAPQELPQAKGSDDELFLGGSNQDSVQGLGRAVCPAGGEAGLGGCSSSTNGSSGGCEQELGLDLSKKSPPLPPATPGPHLTPDDAAQLSDSQHGSPPAASAPPVANSASYSELGGTPDEPMDLEGAEDNHLSLLEAPGGQPRKSLRHSTRKKEWGKKEPVAGSPFERREAGPKGPCPGEEGEGVGDRVPNGILASGAGPSGPYGEPPYPCKEEEENGKDASEDSAQSGSEGGSGHSSAHYMYRQEGYETVSYGDNLYVCIPCAKGFPSSEQLNAHVETHTEEELFIKEEGAYETGSGGAEEEAEDLSAPSAAYTAEPRPFKCSVCEKTYKDPATLRQHEKTHWLTRPFPCNICGKMFTQRGTMTRHMRSHLGLKPFACDECGMRFTRQYRLTEHMRVHSGEKPYECQLCGGKFTQQRNLISHLRMHTSPS

SEQ ID NO: 9934 - protein, 63 aa, Homo sapiens
MKHVLNLYLLGVVLTLLSIFVRVMESLEGLLESPSPGTSWTTRSQLANTEPTKGLPDHPSRSM

SEQ ID NO: 9935 - protein, 200 aa, Homo sapiens
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 9936 - protein, 1017 aa, Homo sapiens
MKLLKPTWVNHNGKPIFSVDIHPDGTKFATGGQGQDSGKVVIWNMSPVLQEDDEKDENIPKMLCQMDNHLACVNCVRWSNSGMYLASGGDDKLIMVWKRATYIGPSTVFGSSGKLANVEQWRCVSILRNHSGDVMDVAWSPHDAWLASCSVDNTVVIWNAVKFPEILATLRGHSGLVKGLTWDPVGKYIASQADDRSLKVWRTLDWQLETSITKPFDECGGTTHVLRLSWSPDGHYLVSAHAMNNSGPTAQIIEREGWKTNMDFVGHRKAVTVVKFNPKIFKKKQKNGSSAKPSCPYCCCAVGSKDRSLSVWLTCLKRPLVVIHELFDKSIMDISWTLNGLGILVCSMDGSVAFLDFSQDELGDPLSEEEKSRIHQSTYGKSLAIMTEAQLSTAVIENPEMLKYQRRQQQQQLDQKSAATREMGSATSVAGVVNGESLEDIRKNLLKKQVETRTADGRRRITPLCIAQLDTGDFSTAFFNSIPLSGSLAGTMLSSHSSPQLLPLDSSTPNSFGASKPCTEPVVAASARPAGDSVNKDSMNATSTPAALSPSVLTTPSKIEPMKAFDSRFTERSKATPGAPALTSMTPTAVERLKEQNLVKELRPRDLLESSSDSDEKVPLAKASSLSKRKLELEVETVEKKKKGRPRKDSRLMPVSLSVQSPAALTAEKEAMCLSAPALALKLPIPSPQRAFTLQVSSDPSMYIEVENEVTVVGGVKLSRLKCNREGKEWETVLTSRILTAAGSCDVVCVACEKRMLSVFSTCGRRLLSPILLPSPISTLHCTGSYVMALTAAATLSVWDVHRQVVVVKEESLHSILAGSDMTVSQILLTQHGIPVMNLSDGKAYCFNPSLSTWNLVSDKQDSLAQCADFRSSLPSQDAMLCSGPLAIIQGRTSNSGRQAARLFSVPHVVQQETTLAYLENQVAAALTLQSSHEYRHWLLVYARYLVNEGFEYRLREICKDLLGPVHYSTGSQWESTVVGLRKRELLKELLPVIGQNLRFQRLFTECQEQLDILRDK

SEQ ID NO: 9937 - protein, 2500 aa, Homo sapiens
MLFLNLATAHQEIEYISPPLEHGSNQALRSTALETLHESALLSGELALKTLCNKMDTGDTALGQKATSRSGETDKASGRWRQEQSAVIKMSTFGSHEGQRQPQIEPEQIGNTASAQLFGSGKLASPSEVVQQVAEKQYPPHRPSPYSCQHSLSFPQHSLPQGVMHSTKPHQSLEGPPWLFPGPLPSVASEDLFPFPIHGHSGGYPRKKISSLNPAYSQYSQKSIEQAEEAHKKEHKPKKPGKYICPYCSRACAKPSVLKKHIRSHTGERPYPCIPCGFSFKTKSNLYKHRKSHAHAIKAGLVPFTESAVSKLDLEAGFIDVEAEIHSDGEQSTDTDEESSLFAEASDKMSPGPPIPLDIASRGGYHGSLEESLGGPMKVPILIIPKSGIPLPNESSQYIGPDMLPNPSLNTKADDSHTVKQKLALRLSEKKGQDSEPSLNLLSPHSKGSTDSGYFSRSESAEQQISPPNTNAKSYEEIIFGKYCRLSPRNALSVTTTSQERAAMGRKGIMEPLPHVNTRLDVKMFEDPVSQLIPSKGDVDPSQTSMLKSTKFNSESRQPQIIPSSIRNEGKLYPANFQGSNPVLLEAPVDSSPLIRSNSVPTSSATNLTIPPSLRGSHSFDERMTGSDDVFYPGTVGIPPQRMLRRQAAFELPSVQEGHVEVEHHGRMLKGISSSSLKEKKLSPGDRVGYDYDVCRKPYKKWEDSETPKQNYRDISCLSSLKHGGEYFMDPVVPLQGVPSMFGTTCENRKRRKEKSVGDEEDTPMICSSIVSTPVGIMASDYDPKLQMQEGVRSGFAMAGHENLSHGHTERFDPCRPQLQPGSPSLVSEESPSAIDSDKMSDLGGRKPPGNVISVIQHTNSLSRPNSFERSESAELVACTQDKAPSPSETCDSEISEAPVSPEWAPPGDGAESGGKPSPSQQVQQQSYHTQPRLVRQHNIQVPEIRVTEEPDKPEKEKEAQSKEPEKPVEEFQWPQRSETLSQLPAEKLPPKKKRLRLADMEHSSGESSFESTGTGLSRSPSQESNLSHSSSFSMSFEREETSKLSALPKQDEFGKHSEFLTVPAGSYSLSVPGHHHQKEMRRCSSEQMPCPHPAEVPEVRSKSFDYGNLSHAPVSGAAASTVSPSRERKKCFLVRQASFSGSPEISQGEVGMDQSVKQEQLEHLHAGLRSGWHHGPPAVLPPLQQEDPGKQVAGPCPPLSSGPLHLAQPQIMHMDSQESLRNPLIQPTSYMTSKHLPEQPHLFPHQETIPFSPIQNALFQFQYPTVCMVHLPAQQPPWWQAHFPHPFAQHPQKSYGKPSFQTEIHSSYPLEHVAEHTGKKPAEYAHTKEQTYPCYSGASGLHPKNLLPKFPSDQSSKSTETPSEQVLQEDFASANAGSLQSLPGTVVPVRIQTHVPSYGSVMYTSISQILGQNSPAIVICKVDENMTQRTLVTNAAMQGIGFNIAQVLGQHAGLEKYPIWKAPQTLPLGLESSIPLCLPSTSDSVATLGGSKRMLSPASSLELFMETKQQKRVKEEKMYGQIVEELSAVELTNSDIKKDLSRPQKPQLVRQGCASEPKDGLQSGSSSFSSLSPSSSQDYPSVSPSSREPFPPSKEMLSGSRAPLPGQKSSGPSESKESSDELDIDETASDMSMSPQSSSLPAGDGQLEEEGKGHKRPVGMLVRMASAPSGNVADSTLLLTDMADFQQILQFPSLRTTTTVSWCFLNYTKPNYVQQATFKSSVYASWCISSCNPNPSGLNTKTTLALLRSKQKITAEIYTLAAMHRPGTGKLTSSSAWKQFTQMKPDASFLFGSKLERKLVGNILKERGKGDIHGDKDIGSKQTEPIRIKIFEGGYKSNEDYVYVRGRGRGKYICEECGIRCKKPSMLKKHIRTHTDVRPYVCKLCNFAFKTKGNLTKHMKSKAHMKKCLELGVSMTSVDDTETEEAENLEDLHKAAEKHSMSSISTDHQFSDAEESDGEDGDDNDDDDEDEDDFDDQGDLTPKTRSRSTSPQPPRFSSLPVNVGAVPHGVPSDSSLGHSSLISYLVTLPSIRVTQLMTPSDSCEDTQMTEYQRLFQSKSTDSEPDKDRLDIPSCMDEECMLPSEPSSSPRDFSPSSHHSSPGYDSSPCRDNSPKRYLIPKGDLSPRRHLSPRRDLSPMRHLSPTKEAALRREMSQRDVSPRRHLSPRRPVSPGKDITARRDLSPRRERRYMTTIRAPSPRRALYHNPPLSMGQYLQAEPIVLGPPNLRRGLPQVPYFSLYGDQEGAYEHPGSSLFPEGPNDYVFSHLPLHSQQQVRAPIPMVPVGGIQMVHSMPPALSSLHPSPTLPLPMEGFEEKKGASGESFSKDPYVLSKQHEKRGPHALQSSGPPSTPSSPRLLMKQSTSEDSLNATEREQEENIQTCTKAIASLRIATEEAALLGPDQPARVQEPHQNPLGSAHVSIRHFSRPEPGQPCTSATHPDLHDGEKDNFGTSQTPLAHSTFYSKSCVDDKQLDFHSSKELSSSTEESKDPSSEKSQLH

SEQ ID NO: 9938 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 9939 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 9940 - protein, 200 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 9941 - protein, 287 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 9942 - protein, 306 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 9943 - protein, 336 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 9944 - protein, 355 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 9945 - protein, 449 aa, Homo sapiens
MMLSTEGREGFVVKVRGLPWSCSADEVMRFFSDCKIQNGTSGIRFIYTREGRPSGEAFVELESEEEVKLALKKDRETMGHRYVEVFKSNSVEMDWVLKHTGPNSPDTANDGFVRLRGLPFGCSKEEIVQFFSGLEIVPNGMTLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYNFFSPLNPMRVHIEIGPDGRVTGEADVEFATHEDAVAAMAKDKANMQHRYVELFLNSTAGTSGGAYDHSYVELFLNSTAGASGGAYGSQMMGGMGLSNQSSYGGPASQQLSGGYGGGYGGQSSMSGYDQVLQENSSDYQSNLA

SEQ ID NO: 9946 - protein, 449 aa, Homo sapiens; identical to SEQ ID NO: 9945

SEQ ID NO: 9947 - protein, 719 aa, Homo sapiens
MSVDKAELCGSLLTWLQTFHVPSPCASPQDLSSGLAVAYVLNQIDPSWFNEAWLQGISEDPGPNWKLKVSNLKMVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRRYYFLSEEAEEGDELQQRCLDLERQLMLLSEEKQSLAQENAGLRERMGRPEGEGTPGLTAKKLLLLQSQLEQLQEENFRLESGREDERLRCAELEREVAELQHRNQALTSLAQEAQALKDEMDELRQSSERAGQLEATLTSCRRRLGELRELRRQVRQLEERNAGHAERTRQLEDELRRAGSLRAQLEAQRRQVQELQGQLQEEAMKAEKWLFECRNLEEKYESVTKEKERLLAERDSLREANEELRCAQLQPRGLTQADPSLDPTSTPVDNLAAEILPAELRETLLRLQLENKRLCRQEAADRERQEELQRHLEDANRARHGLETQHRLNQQQLSELRAQVEDLQKALQEQGGKTEDAISILLKRKLEEHLQKLHEADLELQRKREYIEELEPPTDSSTARRIEELQHNLQKKDADLRAMEERYRRYVDKARMVMQTMEPKQRPAAGAPPELHSLRTQLRERDVRIRHLEMDFEKSRSQREQEEKLLISAWYNMGMALQQRAGEERAPAHAQSFLAQQRLATNSRRGPLGRLASLNLRPTDKH

SEQ ID NO: 9948 - protein, 718 aa, Homo sapiens
MFSVESLERAELCESLLTWIQTFNVDAPCQTVEDLTNGVVMAQVLQKIDPAYFDENWLNRIKTEVGDNWRLKISNLKKILKGILDYNHEILGQQINDFTLPDVNLIGEHSDAAELGRMLQLILGCAVNCEQKQEYIQAIMMMEESVQHVVMTAIQELMSKESPVSAGNDAYVDLDRQLKKTTEELNEALSAKEEIAQRCHELDMQVAALQEEKSSLLAENQVLMERLNQSDSIEDPNSPAGRRHLQLQTQLEQLQEETFRLEAAKDDYRIRCEELEKEISELRQQNDELTTLADEAQSLKDEIDVLRHSSDKVSKLEGQVESYKKKLEDLGDLRRQVKLLEEKNTMYMQNTVSLEEELRKANAARSQLETYKRQVVELQNRLSEESKKADKLDFEYKRLKEKVDSLQKEKDRLRTERDSLKETIEELRCVQAQEGQLTTQGLMPLGSQESSDSLAAEIVTPEIREKLIRLQHENKMLKLNQEGSDNEKIALLQSLLDDANLRKNELETENRLVNQRLLEVQSQVEELQKSLQDQGSKAEDSVLLKKKLEEHLEKLHEANNELQKKRAIIEDLEPRFNNSSLKIEELQEALRKKEEEMKQMEERYKKYLEKAKSVIRTLDPKQNQGAAPEIQALKNQLQERDRLFHSLEKEYEKTKSQREMEEKYIVSAWYNMGMTLHKKAAEDRLASTGSGQSFLARQRQATSSRRSYPGHVQPATAR

SEQ ID NO: 9949 - protein, 73 aa, Homo sapiens
MSAETASGPTEDQVEILEYNFNKVDKHPDSTTLCLIAAEAGLSEEETQKWFKQRLAKWRRSEGLPSECRSVTD

SEQ ID NO: 9950 - protein, 73 aa, Homo sapiens; identical to SEQ ID NO: 9949

SEQ ID NO: 9951 - protein, 73 aa, Homo sapiens; identical to SEQ ID NO: 9949

SEQ ID NO: 9952 - protein, 218 aa, Homo sapiens
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 9953 - protein, 529 aa, Homo sapiens
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 9954 - protein, 840 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEERNFTTEQVTAMLLSKLKETAESVLKKPVVDCVVSVPCFYTDAERRSVMDATQIAGLNCLRLMNETTAVALAYGIYKQDLPALEEKPRNVVFVDMGHSAYQVSVCAFNRGKLKVLATAFDTTLGGRKFDEVLVNHFCEEFGKKYKLDIKSKIRALLRLSQECEKLKKLMSANASDLPLSIECFMNDVDVSGTMNRGKFLEMCNDLLARVEPPLRSVLEQTKLKKEDIYAVEIVGGATRIPAVKEKISKFFGKELSTTLNADEAVTRGCALQCAILSPAFKVREFSITDVVPYPISLRWNSPAEEGSSDCEVFSKNHAAPFSKVLTFYRKEPFTLEAYYSSPQDLPYPDPAIAQFSVQKVTPQSDGSSSKVKVKVRVNVHGIFSVSSASLVEVHKSEENEEPMETDQNAKEEEKMQVDQEEPHVEEQQQQTPAENKAESEEMETSQAGSKDKKMDQPPQAKKAKVKTSTVDLPIENQLLWQIDREMLNLYIENEGKMIMQDKLEKERNDAKNAVEEYVYEMRDKLSGEYEKFVSEDDRNSFTLKLEDTENWLYEDGEDQPKQVYVDKLAELKNLGQPIKIRFQESEERPKLFEELGKQIQQYMKIISSFKNKEDQYDHLDAADMTKVEKSTNEAMEWMNNKLNLQNKQSLTMDPVVKSKEIEAKIKELTSTCSPIISKPKPKVEPPKEEQKNAEQNGPVDGQGDNPGPQAAEQGTDTAVPSDSDKKLPEMDID

SEQ ID NO: 9955 - protein, 148 aa, Homo sapiens
MSVVGIDLGFQSCYVAVARAGGIETIANEYSDRCTPACISFGPKNRSIGAAAKSQVISNAKNTVQGFKRFHGRAFSDPFVEAEKSNLAYDIVQLPTGLTGIKVTYMEEEQNGPVDGQGDNPGPQAAEQGTDTAVPSDSDKKLPEMDID

SEQ ID NO: 9956 - protein, 513 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 9957 - protein, 461 aa, Homo sapiens
MAEVGEIIEGCRLPVLRRNQDNEDEWPLAEILSVKDISGRKLFYVHYIDFNKRLDEWVTHERLDLKKIQFPKKEAKTPTKNGLPGSRPGSPEREVKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 9958 - protein, 546 aa, Homo sapiens
MAEVVSPVPGAGRREPGEVGRARGPPVADPGVALSPQGEIIEGCRLPVLRRNQDNEDEWPLAEILSVKDISGRKLFYVHYIDFNKRLDEWVTHERLDLKKIQFPKKEAKTPTKNGLPGSRPGSPEREVPASAQASGKTLPIPVQITLRFNLPKEREAIPGGEPDQPLSSSSCLQPNHRSTKRKVEVVSPATPVPSETAPASVFPQNGAARRAVAAQPGRKRKSNCLGTDEDSQDSSDGIPSAPRMTGSLVSDRSHDDIVTRMKNIECIELGRHRLKPWYFSPYPQELTTLPVLYLCEFCLKYGRSLKCLQRHLTKCDLRHPPGNEIYRKGTISFFEIDGRKNKSYSQNLCLLAKCFLDHKTLYYDTDPFLFYVMTEYDCKGFHIVGYFSKEKESTEDYNVACILTLPPYQRRGYGKLLIEFSYELSKVEGKTGTPEKPLSDLGLLSYRSYWSQTILEILMGLKSESGERPQITINEISEITSIKKEDVISTLQYLNLINYYKGQYILTLSEDIVDGHERAMLKRLLRIDSKCLHFTPKDWSKRGKW

SEQ ID NO: 9959 - protein, 431 aa, Homo sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 9960 - protein, 129 aa, Homo sapiens
MRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 9961 - protein, 1262 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLIAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 9962 - protein, 1262 aa, Homo sapiens; identical to SEQ ID NO: 9961

SEQ ID NO: 9963 - protein, 632 aa, Homo sapiens
MNRYTTIRQLGDGTYGSVLLGRSIESGELIAIKKMKRKFYSWEECMNLREVKSLKKLNHANVVKLKEVIRENDHLYFIFEYMKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQALRYPYFQVGHPLGSTTQNLQDSEKPQKGILEKAGPPPYIKPVPPAQPPAKPHTRISSRQHQASQPPLHLTYPYKAEVSRTDHPSHLQEDKPSPLLFPSLHNKHPQSKITAGLEHKNGEIKPKSRRRWGLISRSTKDSDDWADLDDLDFSPSLSRIDLKNKKRQSDDTLCRFESVLDLKPSEPVGTGNSAPTQTSYQRRDTPTLRSAAKQHYLKHSRYLPGISIRNGILSNPGKEFIPPNPWSSSGLSGKSSGTMSVISKVNSVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 9964 - protein, 632 aa, Homo sapiens; identical to SEQ ID NO: 9963

SEQ ID NO: 9965 - protein, 36 aa, Homo sapiens
MKAFSPVRSIRKNSLLDHRLGISQSKTPVDDLMSLL

SEQ ID NO: 9966 - protein, 437 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNKCTEEDLEFYVRKCGDILGVTSKLPKDQQDAKHILEHVFFQVVEFKKLNQEHDIDTSETAFQNNF

SEQ ID NO: 9967 - protein, 159 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 9968 - protein, 411 aa, Homo sapiens
MSPARLRPRLHFCLVLLLLLVVPAAWGCGPGRVVGSRRRPPRKLVPLAYKQFSPNVPEKTLGASGRYEGKIARSSERFKELTPNYNPDIIFKDEENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLILLDREPHRLRAFQVIETQDPPRRLALTPAHLLFTADNHTEPAARFRATFASHVQPGQYVLVAGAPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 9969 - protein, 97 aa, Homo sapiens
MSPAFRAMDVEPRAKGVLLEPFVHQVGGHSCVLRFNETTLCKPLVPREHQFYETLPAEMRKFTPQYKGQSQRPLVSWPSLPHFFPWSFPLWPQGSVA

SEQ ID NO: 9970 - protein, 97 aa, Homo sapiens; identical to SEQ ID NO: 9969

SEQ ID NO: 9971 - protein, 70 aa, Homo sapiens
MSPAFRAMDVEPRAKGVLLEPFVHQVGGHSCVLRFNETTLCKPLVPREHQFYETLPAEMRKFTPQYKGVS

SEQ ID NO: 9972 - protein, 70 aa, Homo sapiens; identical to SEQ ID NO: 9971

SEQ ID NO: 9973 - protein, 202 aa, Homo sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 9974 - protein, 696 aa, Homo sapiens
MKAPIPHLILLYATFTQSLKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 9975 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 9976 - protein, 632 aa, Homo sapiens
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 9977 - protein, 277 aa, Homo sapiens
MADPWQECMDYAVTLARQAGEVVCEAIKNEMNVMLKSSPVDLVTATDQKVEKMLISSIKEKYPSHSFIGEESVAAGEKSILTDNPTWIIDPIDGTTNFVHRFPFVAVSIGFAVNKKIEFGVVYSCVEGKMYTARKGKGAFCNGQKLQVSQQEDITKSLLVTELGSSRTPETVRMVLSNMEKLFCIPVHGIRSVGTAAVNMCLVATGGADAYYEMGIHCWDVAGAGIIVTEAGGVLMDVTGGPFDLMSRRVIAANNRILAERIAKEIQVIPLQRDDED

SEQ ID NO: 9978 - protein, 422 aa, Homo sapiens
MSFVECPYHSPAERLVAEADEGGPSAITGMGLCFRCLLFSFSGRSGVEGGRVDLNVFGSLGLQPWIGSSRCWGGPCSSALRCGWFSSWPPPSKSAIPIGGGSRGAGRVSRWPPPHWLEAWRVSPLPLSPLSPATFGRGFIAVAVIPGLWARGRGCSSDRLPRPAGPARRQFQAASLLTRGWGRAWPWKQILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 9979 - protein, 416 aa, Homo sapiens
MATEPPSPLRVEAPGPPEMRTSPAIESTPEGTPQPAGGRLRFLNGCVPLSHQVAGHMYGKDKVGILQHPDGTVLKQLQPPPRGPRELEFYNMVYAADCFDGVLLELRKYLPKYYGIWSPPTAPNDLYLKLEDVTHKFNKPCIMDVKIGQKSYDPFASSEKIQQQVSKYPLMEEIGFLVLGMRVYHVHSDSYETENQHYGRSLTKETIKDGVSRFFHNGYCLRKDAVAASIQKIEKILQWFENQKQLNFYASSLLFVYEGSSQPTTTKLNDRTLAEKFLSKGQLSDTEVLEYNNNFHVLSSTANGKIESSVGKSLSKMYARHRKIYTKKHHSQTSLKVENLEQDNGWKSMSQEHLNGNVLSQLEKVFYHLPTGCQEIAEVEVRMIDFAHVFPSNTIDEGYVYGLKHLISVLRSILDN

SEQ ID NO: 9980 - protein, 963 aa, Homo sapiens
MWCLHCNSERTQSLLELELDSGVEGEAPSSETGTSLDSPSAYPQGPLVPGSSLSPDHYEHTSVGAYGLYSGPPGQQQRTRRPKLQHSTSILRKQAEEEAIKRSRSLSESYELSSDLQDKQVEMLERKYGGRLVTRHAARTIQTAFRQYQMNKNFERLRSSMSENRMSRRIVLSNMRMQFSFEGPEKVHSSYFEGKQVSVTNDGSQLGALVSPECGDLSEPTTLKSPAPSSDFADAITELEDAFSRQVKSLAESIDDALNCRSLHTEEAPALDAARARDTEPQTALHGMDHRKLDEMTASYSDVTLYIDEEELSPPLPLSQAGDRPSSTESDLRLRAGGAAPDYWALAHKEDKADTDTSCRSTPSLERQEQRLRVEHLPLLTIEPPSDSSVDLSDRSERGSLKRQSAYERSLGGQQGSPKHGPHSGAPKSLPREEPELRPRPPRPLDSHLAINGSANRQSKSESDYSDGDNDSINSTSNSNDTINCSSESSSRDSLREQTLSKQTYHKEARNSWDSPAFSNDVIRKRHYRIGLNLFNKKPEKGVQYLIERGFVPDTPVGVAHFLLQRKGLSRQMIGEFLGNRQKQFNRDVLDCVVDEMDFSTMELDEALRKFQAHIRVQGEAQKVERLIEAFSQRYCICNPGVVRQFRNPDTIFILAFAIILLNTDMYSPNVKPERKMKLEDFIKNLRGVDDGEDIPREMLMGIYERIRKRELKTNEDHVSQVQKVEKLIVGKKPIGSLHPGLGCVLSLPHRRLVCYCRLFEVPDPNKPQKLGLHQREIFLFNDLLVVTKIFQKKKNSVTYSFRQSFSLYGMQVLLFENQYYPNGIRLTSSVPGADIKVLINFNAPNPQDRKKFTDDLRESIAEVQEMEKHRIESELEKQKGVVRPSMSQCSSLKKESGNGTLSRACLDDSYASGEGLKRSALSSSLRDLSEAGKRGRRSSAGSLESNVEFQPFEPLQPSVLCS

SEQ ID NO: 9981 - protein, 860 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 9982 - protein, 880 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 9983 - protein, 260 aa, Homo sapiens
MSLQKTPPTRVFVELVPWADRSRENNLASGRETLPGLRHPLSSTQAQTATREVQVSGTSEVSAGPDRAQVVVRVSSTKEAAAEAKKSVCRRLDYITQSLQQQGVQAENITVTKDFRRVENAYHMEAEVCITFTEFGKMQNICNFLVEKLDSSVVISPPQFYHTPGSVENLRRQACLVAVENAWRKAQEVCNLVGQTLGKPLLIKEEETKEWEGQIDDHQSSRLSSSLTVQQKIKSATIHAASKVFITFEVKGKEKRKKHL

SEQ ID NO: 9984 - protein, 353 aa, Homo sapiens
MSTLLLNLDFGEPPPKKALEGNAKHRNFVKKRRLLERRGFLSKKNQPPSKAPKLHSEPSKKGETPTVDGTWKTPSFPKKKTAASSNGSGQPLDKKAAVSWLTPAPSKKADSVAAKVDLLGEFQSALPKINSHPTRSQKKSSQKKSSKKNHPQKNAPQNSTQAHSENKCSGASQKLPRKMVAIDCEMVGTGPKGHVSSLARCSIVNYNGDVLYDEYILPPCHIVDYRTRWSGIRKQHMVNATPFKIARGQILKILTGKIVVGHAIHNDFKALQYFHPKSLTRDTSHIPPLNRKADCPENATMSLKHLTKKLLNRDIQVGKSGHSSVEDAQATMELYKLVEVEWEEHLARNPPTD

SEQ ID NO: 9985 - protein, 745 aa, Homo sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 9986 - protein, 350 aa, Homo sapiens
MGPHFTLLCAALAGCLLPAEGCVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGERNVEVPQMEDMILDCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASRLLGLLICGSLALITGLTFAIFRRRKVIDFIKSSLFGLGSGVAEQTQVPKEKATDSRQQ

SEQ ID NO: 9987 - protein, 1142 aa, Homo sapiens
MAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKTICDSSVSTHDLKVKYLATLETLTKHYGAEIFETSMLLISSENEMNWFHSNDGGNVLYYEVMVTGNLGIQWRHKPNVVSVEKEKNKLKRKKLENKDKKDEEKNKIREEWNNFSFFPEITHIVIKESVVSINKQDNKKMELKLSSHEEALSFVSLVDGYFRLTADAHHYLCTDVAPPLIVHNIQNGCHGPICTEYAINKLRQEGSEEGMYVLRWSCTDFDNILMTVTCFEKSEQVQGAQKQFKNFQIEVQKGRYSLHGSDRSFPSLGDLMSHLKKQILRTDNISFMLKRCCQPKPREISNLLVATKKAQEWQPVYPMSQLSFDRILKKDLVQGEHLGRGTRTHIYSGTLMDYKDDEGTSEEKKIKVILKVLDPSHRDISLAFFEAASMMRQVSHKHIVYLYGVCVRDVENIMVEEFVEGGPLDLFMHRKSDVLTTPWKFKVAKQLASALSYLEDKDLVHGNVCTKNLLLAREGIDSECGPFIKLSDPGIPITVLSRQECIERIPWIAPECVEDSKNLSVAADKWSFGTTLWEICYNGEIPLKDKTLIEKERFYESRCRPVTPSCKELADLMTRCMNYDPNQRPFFRAIMRDINKLEEQNPDIVSRKKNQPTEVDPTHFEKRFLKRIRDLGEGHFGKVELCRYDPEDNTGEQVAVKSLKPESGGNHIADLKKEIEILRNLYHENIVKYKGICTEDGGNGIKLIMEFLPSGSLKEYLPKNKNKINLKQQLKYAVQICKGMDYLGSRQYVHRDLAARNVLVESEHQVKIGDFGLTKAIETDKEYYTVKDDRDSPVFWYAPECLMQSKFYIASDVWSFGVTLHELLTYCDSDSSPMALFLKMIGPTHGQMTVTRLVNTLKEGKRLPCPPNCPDEVYQLMRKCWEFQPSNRTSFQNLIEGFEALLK

SEQ ID NO: 9988 - protein, 1124 aa, Homo sapiens
MAPPSEETPLIPQRSCSLLSTEAGALHVLLPARGPGPPQRLSFSFGDHLAEDLCVQAAKASGILPVYHSLFALATEDLSCWFPPSHIFSVEDASTQVLLYRIRFYFPNWFGLEKCHRFGLRKDLASAILDLPVLEHLFAQHRSDLVSGRLPVGLSLKEQGECLSLAVLDLARMAREQAQRPGELLKTVSYKACLPPSLRDLIQGLSFVTRRRIRRTVRRALRRVAACQADRHSLMAKYIMDLERLDPAGAAETFHVGLPGALGGHDGLGLLRVAGDGGIAWTQGEQEVLQPFCDFPEIVDISIKQAPRVGPAGEHRLVTVTRTDNQILEAEFPGLPEALSFVALVDGYFRLTTDSQHFFCKEVAPPRLLEEVAEQCHGPITLDFAINKLKTGGSRPGSYVLRRSPQDFDSFLLTVCVQNPLGPDYKGCLIRRSPTGTFLLVGLSRPHSSLRELLATCWDGGLHVDGVAVTLTSCCIPRPKEKSNLIVVQRGHSPPTSSLVQPQSQYQLSQMTFHKIPADSLEWHENLGHGSFTKIYRGCRHEVVDGEARKTEVLLKVMDAKHKNCMESFLEAASLMSQVSYRHLVLLHGVCMAGDSTMVQEFVHLGAIDMYLRKRGHLVPASWKLQVVKQLAYALNYLEDKGLPHGNVSARKVLLAREGADGSPPFIKLSDPGVSPAVLSLEMLTDRIPWVAPECLREAQTLSLEADKWGFGATVWEVFSGVTMPISALDPAKKLQFYEDRQQLPAPKWTELALLIQQCMAYEPVQRPSFRAVIRDLNSLISSDYELLSDPTPGALAPRDGLWNGAQLYACQDPTIFEERHLKYISQLGKGNFGSVELCRYDPLGDNTGALVAVKQLQHSGPDQQRDFQREIQILKALHSDFIVKYRGVSYGPGRQSLRLVMEYLPSGCLRDFLQRHRARLDASRLLLYSSQICKGMEYLGSRRCVHRDLAARNILVESEAHVKIADFGLAKLLPLDKDYYVVREPGQSPIFWYAPESLSDNIFSRQSDVWSFGVVLYELFTYCDKSCSPSAEFLRMMGCERDVPALCRLLELLEEGQRLPAPPACPAEVHELMKLCWAPSPQDRPSFSALGPQLDMLWSGSRGCETHAFTAHPEGKHHSLSFS

SEQ ID NO: 9989 - protein, 1246 aa, Homo sapiens [sequence omitted]

SEQ ID NO: 9990 - protein, 634 aa, Homo sapiens
MVELLDLYQLEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPPPPPPPPPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 9991 - protein, 2985 aa, Homo sapiens
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 9992 - protein, 1663 aa, Homo sapiens
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKDGNLVPRWHLGPGDPFSTYV

SEQ ID NO: 9993 - protein, 1289 aa, Homo sapiens
MKGGDRAYTRGPSLGWLFAKCCCCFPCRDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 9994 - protein, 959 aa, Homo sapiens
  VARIANT 822, 849, 891, 951, 952: Xaa = Any Amino Acid
MGEDRVDKPTGSLIHTAFLILPDKLAPLDPSGPSHRYPPALSALHQPSCAHPRPRALCASGRGRSRAPEVRALFPCEKPPRPTEMSRHHSRFERDYRVGWDRREWSVNGTHGTTSICSVTSGAGGGTASSLSVRPGLLPLPVVPSRLPTPATAPAPCTTGSSEAITSLVASSASAVTTKAPGISKGDSQSQGLATSIRWGQTPINQSTPWDTDEPPSKQMRESDNPGTGPWVTTVAAGNQPTLIAHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVERYDTITNQWEAVALCPRQYTLLQPQCVAARSTCLVGXTRQAELPASSSLTFLRPTRGASSSPQXLTTSMPPLSRSMASFSSWAGLMPELPPSTTLRKETLRRAQTXTTLASSAVLWCLMARFMQLEVLSAVKGPRWATWRPTSPQPTHGPSSPTCPALCSDTAASXXRNIFKAA

SEQ ID NO: 9995 - protein, 1120 aa, Homo sapiens
MGEDRVDKPTGSLIHTAFLILPDKLAPLVSCYQTSALKSLRCPRTSALRTTMARFPQVLRADGELASVPGPQPWASKARRPRRSSPCHAPCVCRARPRSQPHRLTGRRTDFPLPGILPGLPGGGGGGGGGGTRGEGGEQEREEEDLDPFPPARTRAAPATATRRRCPLSISPPAPTRDPGLSARRAGAGAARPETIWLPGDAHALLSVGGHRGFRILGTNPELARDGRRKVRALFPCEKPPRPTEMSRHHSRFERDYRVGWDRREWSVNGTHGTTSICSVTSGAGGGTASSLSVRPGLLPLPVVPSRLPTPATAPAPCTTGSSEAITSLVASSASAVTTKAPGISKGDSQSQGLATSIRWGQTPINQSTPWDTDEPPSKQMRESDNPGTGPWVTTVAAGNQPTLIAHSYGVAQPPTFSPAVNVQAPVIGVTPSLPPHVGPQLPLMPGHYSLPQPPSQPLSSVVVNMPAQALYASPQPLAVSTLPGVGQVARPGPTAVGNGHMAGPLLPPPPPAQPSATLPSGAPATNGPPTTDSAHGLQMLRTIGVGKYEFTDPGHPREMLKELNQQRRAKAFTDLKIVVEGREFEVHQNVLASCSLYFKDLIQRSVQDSGQGGREKLELVLSNLQADVLELLLEFVYTGSLVIDSANAKTLLEAASKFQFHTFCKVCVSFLEKQLTASNCLGVLAMAEAMQCSELYHMAKAFALQIFPEVAAQEEILSISKDDFIAYVSNDSLNTKAEELVYETVIKWIKKDPATRTQYAAELLAVVRLPFIHPSYLLNVVDNEELIKSSEACRDLVNEAKRYHMLPHARQEMQTPRTRPRLSAGVAEVIVLVGGRQMVGMTQRSLVAVTCWNPQNNKWYPLASLPFYDREFFSVVSAGDNIYLSGGMESGVTLADVWCYMSLLDNWNLVSRMTVPRCRHNSLVYDGKIYTLGGLGVAGNVDHVERYDTITNQWEAVAPLPKAVHSAAATVCGGKIYVFGGVNEAGRAAGVLQSYVPQTNTWSFIESPMIDNKYAPAVTLNGFVFILGGAYARATTIYDPEKGNIKAGPNMNHSRQFCSAVVLDGKIYATGGIVSSEGPALGNMEAYEPTTNTWTLLPHMPCPVFRHGCVVIKKYIQSG

SEQ ID NO: 9996 - protein, 613 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKDNCKEVVITGYTQAEARSLT

SEQ ID NO: 9997 - protein, 558 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSDNCKEVVITGYTQAEARSLT

SEQ ID NO: 9998 - protein, 393 aa, Homo sapiens
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 9999 - protein, 1182 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 10000 - protein, 545 aa, Homo sapiens
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHELRAQAQVEEAEELFRDMRFYGPQRRRLWNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQVGCLLLFIAMGIFTFSAAVYSVEHDVPSTNFTTIPHSWWWAAVSISTVGYGDMYPETHLGRFFAFLCIAFGIILNGMPISILYNKFSDYYSKLKAYEYTTIRRERGEVNFMQRARKKIAECLLGSNPQLTPRQEN

SEQ ID NO: 10001 - protein, 426 aa, Homo sapiens
MEGHKAEEEVLDVLRLNVGGCIYTARRESLCRFKDSMLASMFSGRFPLKTDESGACVIDRDGRLFKYLLDYLHGEVQIPTDEQTRIALQEEADYFGIPYPYSLSDHLANEMETYSLRSNIELKKALTDFCDSYGLVCNKPTVWVLHYLNTSGASCESRIIGVYATKTDGTDAIEKQLGGRIHSKGIFKREAGNNVQYIWSYYSVAELKKMMDAFDAWEGKGVSYWRVPHELIECWTLEERPLLGSLRHMAPIRKRRLITFNEADESVNYKTGPKPVRFLGPSTSTQIKVKNSASVTVSPASAIQTSAGATANRFQSGSRRKAAQRSAPSRATALVGTGAPGHPQASPGAASAENGGTHLPPAKVLLSDKKPTPQRVIKLKRTPLCATAPCLPSPTATRQANSLKPLPGEAARALGVRTENGKNKGN

SEQ ID NO: 10002 - protein, 292 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 10003 - protein, 1159 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRRRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 10004 - protein, 1070 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEVLGRCFLTVVQVHFQFLTHALQKVQPVAHSCFAEVIVPEKKNSGSGGGLSGMGHTPEVEEAVRSWRGAAEATSRLRERGCDGCLAGIEVQQLFCSQSAAIPEHQLKELNIKIDSALQAYKIALESLGHCEYAMKAGFHLNPKAIEASLQGCCSEAEAQQTGRRQTPPQPMQCELPTVPVQIGSHFLKGVSFNESAADNLKLKTHTMLQLMKEAGCYNGITSRDDFPVTEVLNQVCPSTWRGACKTAVQLLFGQAGLVVVDTAQIENKEAYAPQISLEGSRIVVQVPSTWCLKEDPATMSLLQRSLDPEKTLGLVDVLYTAVLDLNRWRAGREQALPCIQIQLQREICDFGNQADLPSGNGNKSSGGLQKTFSKLTSRFTKKASCTSSSSSTNYSIQNTPSKNIFIAGCSEEKAKMPGNIDTRLQSILNIGNFPRTTDPSQSAQNSSNTVANGFLMERRENFLHGDDGKDEKGMNLPTDQEMQEVIDFLSGFNMGQSHQGSPLVTRHNSAATAMVTEQKAGAMQPQQPSLPVPPPPRAPQAGAHTPLTPQPGLAPQQQSPKQQQPQVQYYQHLLQPIGPQQPPPQPRAPGKWVHGSSQQPAQAVGAGLSPLGQWPGISDLSSDLYSLGLVSSYMDNVMSEVLGQKPQGPRNNTWPNRDQSDGVFGMLGEILPFDPAVGSDPEFARYVAGVSQAMQQKRQAQHGRRPGNPRGNWPPMDDAHRTWPFPEFFTEGDGLHGGWSGAQGDSASSSDETSSANGDSLFSMFSGPDLVAAVKQRRKHSSGEQDTSTLPSPPLLTTVEDVNQDNKTKTWPPKAPWQHPSPLPSTLPSPSAPLYAVTSPGSQWNDTMQMLQSPVWAATNDCSAAAFSYVQTPPQPPPPPAHKAAPKGFKAFPGKGERRPAYLPQY

SEQ ID NO: 10005 - protein, 694 aa, Homo sapiens
MDLHKQWENTETNWHKEKMELLDQFDNERKEWESQWKIMQKKIEELCREVKLWRKININESAKIIDLYHEKTIPEKVIESSPNYPDLGQSEFIRTNHKDGLRKENKREQSLVSGGNQMCKEQKATKKSKVGFLDPLATDNQKECEAWPDLRTSEEDSKSCSGALSTALEELAKVSEELCSFQEEIRKRSNHRRMKSDSFLQEMPNVTNIPHGDPMINNDQCILPISLEKEKQKNRKNLSCTNVLQSNSTKKCGIDTIDLKRNETPPVPPPRSTSRNFPSSDSEQAYERWKERLDHNSWVPHEGRSKRNYNPHFPLRQQEMSMLYPNEGKTSKDGIIFSSLVPEVKIDSKPPSNEDVGLSMWSCDIGIGAKRSPSTSWFQKTCSTPSNPKYEMVIPDHPAKSHPDLHVSNDCSSSVAESSSPLRNFSCGFERTTRNEKLAAKTDEFNRTVFRTDRNCQAIQQNHSCSKSSEDLKPCDTSSTHTGSISQSNDVSGIWKTNAHMPVPMENVPDNPTKKSTTGLVRQMQGHLSPRSYRNMLHEHDWRPSNLSGRPRSADPRSNYGVVEKLLKTYETATESALQNSKCFQDNWTKCNSDVSGGATLSQHLEMLQMEQQFQQKTAVWGGQEVKQGIDPKKITEESMSVNASHGKGFSRPARPANRRLPSRWASRSPSAPPALRRTTHNYTISLRSEALMV

SEQ ID NO: 10006 - protein, 442 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGGQRSTGGLDGQDQSPYVLTRDGNPLAPPCVFPWQDRDEEPDREADLMPSFLIYSLTRGSFLAKPLASFGL

SEQ ID NO: 10007 - protein, 442 aa, Homo sapiens
MSDRLGQITKGKDGKSKYSTLSLFDKYKGKSVDAIRSSVIPRHGLQSLGKVAAARRMPPPANLPSLKSENKGNDPNIVIVPKDGTGWANKQDQQDPKSATASQPPESLPQPGLQKSVSNLQKPTQSISQENTNSVPGGPKSWAQLNGKPVGHEGGLRGSSRLLSFSPEEFPTLKAAGGQDKAGKEKGVLDLSYGPGPSLRPQNVTSWREGGGRHIISATSLSTSPTELGSRNSSTGDGAPSSACTSDSKDPSLRPAQPVRKGASQFMGNVYHPPTYHDMLPAFMCSPKSSENQGTVERGSFPLPQLRLEPRVPFRQFQMNDQDGKENRLGLSRPLRPLRQLVERAPRPTIINAENLKGLDDLDADADDGWAGGQRSTGGLDGQDQSPSVLTRDGNPLAPPCVFPWQDRDEEPDREADLMPSFLIYSLTSGSFLAKPLASFGL

SEQ ID NO: 10008 - protein, 575 aa, Homo sapiens
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 10009 - protein, 1464 aa, Homo sapiens
MAGIIKKQILKHLSRFTKNLSPDKINLSTLKGEGELKNLELDEEVLQNMLDLPTWLAINKVFCNKASIRIPWTKLKTHPICLSLDKVIMEMSTCEEPRSPNGPSPIATASGQSEYGFAEKVVEGISVSVNSIVIRIGAKAFNASFELSQLRIYSVNAHWEHGDLRFTRIQDPQRGEVLTFKEINWQMIRIEADATQSSHLEIMCAPVRLITNQSKIRVTLKRRLKDCNVIATKLVLILDDLLWVLTDSQLKAMVQYAKSLSEAIEKSTEQRKSMAPEPTQSSTVVASAQQVKTTQTSNAPDVNDAIVKLFNDFDVKETSHHLVISHLDLHICDDIHAKEKESNRRITGGAMQLSFTQLTIDYYPYHKAGDSCNHWMYFSDATKTKNGWANELLHEFECNVEMLKQAVKDHNVGSPPKSPTHASPQHTQTEKDYPLKGTCRTPSVLSQQSKAKLMSSSVVVRLADFNIYQVSTAEQCRSSPKSMICCNKKSLYLPQEMSAVYIEFTEYYYPDGKDFPIPSPNLYSQLNALQFTVDERSILWLNQFLLDLKQSLNQFMAVYKLNDNSKSDEHVDVRVDGLMLKFVIPSEVKSECHQDQPRAISIQSSEMIATNTRHCPNCRHSDLEALFQDFKDCDFFSKTYTSFPKSCDNFNLLHPIFQRHAHEQDTKMHEIYKGNITPQLNKNTLKTSAATDVWAVYFSQFWIDYEGMKSGKGRPISFVDSFPLSIWICQPTRYAESQKEPQTCNQVSLNTSQSESSDLAGRLKRKKLLKEYYSTESEPLTNGGQKPSSSDTFFRFSPSSSEADIHLLVHVHKHVSMQINHYQYLLLLFLHESLILLSENLRKDVEAVTGSPASQTSICIGILLRSAELALLLHPVDQANTLKSPVSESVSPVVPDYLPTENGDFLSSKRKQISRDINRIRSVTVNHMSDNRSMSVDLSHIPLKDPLLFKSASDTNLQKGISFMDYLSDKHLGKISEDESSGLVYKSGSGEIGSETSDKKDSFYTDSSSILNYREDSNILSFDSDGNQNILSSTLTSKGNETIESIFKAEDLLPEAASLSENLDISKEETPPVRTLKSQSSLSGKPKERCPPNLAPLCVSYKNMKRSSSQMSLDTISLDSMILEEQLLESDGSDSHMFLEKGNKKNSTTNYRGTAESVNAGANLQNYGETSPDAISTNSEGAQENHDDLMSVVVFKITGVNGEIDIRGEDTEICLQVNQVTPDQLGNISLRHYLCNRPVGSDQKAVIHSKSSPEISLRFESGPGAVIHSLLAEKNGFLQCHIENFSTEFLTSSLMNIQHFLEDETVATVMPMKIQVSNTKINLKDDSPRSSTVSLEPAPVTVHIDHLVVERSDDGSFHIRDSHMLNTGNDLKENVKSDSVLLTSGKYDLKKQRSVTQATQTSPGVPWPSQSANFPEFSFDFTREQLMEENESLKQELAKAKMALAEAHLEKDALLHHIKKMTVE

SEQ ID NO: 10010 - protein, 47 aa, Homo sapiens
MQEEQPGGQCQLKFLRQDREPEEESQSRCDLWIPHVGSSGPGARGPA

SEQ ID NO: 10011 - protein, 103 aa, Homo sapiens
MERDTEAQDTAMEQARQHTQDTQRRALLLRAQAGAMRRQQHTLRDPMQRLQNQLRRLQDMERKAKVDVTFGSLTSAALGLEPVVLVRVLVMGEGAGSLESGRC

SEQ ID NO: 10012 - protein, 89 aa, Homo sapiens
MELAQEARELGCWAVEEMGVPVAARAPESTLRRLCLGQGADIWAYILQHVHSQRTVKKIRGNLLWYGHQDSPQVRSICYKILFHPKNDL

SEQ ID NO: 10013 - protein, 48 aa, Homo sapiens
MGVPVAARAPESTLRRLCLGQGADIWAYILQHVHSQRTVKKIRGNLLW

SEQ ID NO: 10014 - protein, 47 aa, Homo sapiens; identical to SEQ ID NO: 10010

SEQ ID NO: 10015 - protein, 103 aa, Homo sapiens; identical to SEQ ID NO: 10011

SEQ ID NO: 10016 - protein, 469 aa, Homo sapiens
MELAQEARELGCWAVEEMGVPVAARAPESTLRRLCLGQGADIWAYILQHVHSQRTVKKIRGNLLWYGHQDSPQVRRKLELEAAVTRLRAEIQELDQSLELMERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRPQAPDQSDSSQTLPSMVHLIQEGWRTVGVLVSQRSTLLKERQVLTQRLQGLVEEVERRVLGSSERQVLILGLRRCCLWTELKALHDQSQELQDAAGHRQLLLRELQAKQQRILHWRQLVEETQEQVRLLIKGNSASKTRLCRSPGEVLALVQRKVVPTFEAVAPQSRELLRCLEEEVRHLPHILLGTLLRHRPGE

SEQ ID NO: 10017 - protein, 89 aa, Homo sapiens; identical to SEQ ID NO: 10012

SEQ ID NO: 10018 - protein, 48 aa, Homo sapiens; identical to SEQ ID NO: 10013

SEQ ID NO: 10019 - protein, 1388 aa, Homo sapiens
MASQLQEKCIAFIVDNFSKIIQSENFALLLQSQAMSSTADLLDTILKAIEENITTENSCSLLMALDTLLNSDSTKEMGFTCKIQALRDKLWIFLVQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSATKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGDIDDCDTLAQTRMYDHRPSKTLSPIYEMDVIEAFEQKVESETHVTDMDFEDDQHFAKQDWTLLKQLLSEQDSNLDVTNSVPEDLSLAQYLINQTLLLARDSSKPQGITHIDTLNRWSELTSPLDSSASITMASFSSEDCSPQGEWTILELETQH

SEQ ID NO: 10020 - protein, 1388 aa, Homo sapiens
MASQLQEKCIAFIVDNFSKIIQSENFALLLQSQAMSSTADLLDTILKAIEENITTENSCSLLMALDTLLNSDSTKEMGFTCKIQALRDKLWIFLVQSFYAVRHTESWKLMSTDDQQKIQAAAFDKGDDRRLGKKPIFSSSQQRKQVSDSGDIKIKSWRGNNKKECWSYLSTNKKMKSDGLGASGHSSSTNRNSINKTLKQDDVKEKDGTKIASKITKELKTGGKNVSGKPKTVTKSKTENGDKARLENMSPRQVVERSATAAAAATGQKNLLNGKGVRNQEGQISGARPKVLTGNLNVQAKAKPLKKATGKDSPCLSIAGPSSRSTDSSMEFSISTECLDEPKENGSTEEEKPSGHKLSFCDSPGQMMKNSVDSVKNSTVAIKSRPVSRVTNGTSNKKSIHEQDTNVNNSVLKKVSGKGCSEPVPQAILKKRGTSNGCTAAQQRTKSTPSNLTKTQGSQGESPNSVKSSVSSRQSDENVAKLDHNTTTEKQAPKRKMVKQVHTALPKVNAKIVAMPKNLNQSKKGETLNNKDSKQKMPPGQVISKTQPSSQRPLKHETSTVQKSMFHDVRDNNNKDSVSEQKPHKPLINLASEISDAEALQSSCRPDPQKPLNDQEKEKLALECQNISKLDKSLKHELESKQICLDKSETKFPNHKETDDCDAANICCHSVGSDNVNSKFYSTTALKYMVSNPNENSLNSNPVCDLDSTSAGQIHLISDRENQVGRKDTNKQSSIKCVEDVSLCNPERTNGTLNSAQEDKKSKVPVEGLTIPSKLSDESAMDEDKHATADSDVSSKCFSGQLSEKNSPKNMETSESPESHETPETPFVGHWNLSTGVLHQRESPESDTGSATTSSDDIKPRSEDYDAGGSQDDDGSNDRGISKCGTMLCHDFLGRSSSDTSTPEELKIYDSNLRIEVKMKKQSNNDLFQVNSTSDDEIPRKRPEIWSRSAIVHSRERENIPRGSVQFAQEIDQVSSSADETEDERSEAENVAENFSISNPAPQQFQGIINLAFEDATENECREFSANKKFKRSVLLSVDECEELGSDEGEVHTPFQASVDSFSPSDVFDGISHEHHGRTCYSRFSRESEDNILECKQNKGNSVCKNESTVLDLSSIDSSRKNKQSVSATEKKNTIDVLSSRSRQLLREDKKVNNGSNVENDIQQRSKFLDSDVKSQERPCHLDLHQREPNSDIPKNSSTKSLDSFRSQVLPQEGPVKESHSTTTEKANIALSAGDIDDCDTLAQTRMYDHRPSKTLSPIYEMDVIEAFEQKVESETHVTDMDFEDDQHFAKQDWTLLKQLLSEQDSNLDVTNSVPEDLSLAQYLINQTLLLARDSSKPQGITHIDTLNRWSELTSPLDSSASITMASFSSEDCSPQGEWTILELETQH

SEQ ID NO: 10021 - protein, 1233 aa, Homo sapiens
MGTRAFSHDSIFIPDGGAESEQTVQAMSQDNILGKVKTLQQQLGKNIKFGQRSPNAIPMNKANSGEASLEEDLFLTSPMEIVTQQDIVLSDAENKSSDTPSSLSPLNLPGAGSEMEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQQRSLEAPGWEDAERREREERERLEAEEERRRLQAQAQAEERRRLEEDARLEERRRQEEEEGRCAEELKRQEEEEAEGWEELEQQEAEVQGPPEALEETGEGRRGAEEEDLGEEEEEGQAHLEDWRGQLSELLNDFEERLEDQERLKPEGQREHSEEPGICEEQNPEAERRREQQGRSGDFQGADRPGPEEKREEGDTEPLLKQEGPVEAAQPPVERKEAAALEQGRKVEELRWQEVDERQTMPRPYTFQVSSGGKQILFPKVNLSPVTPAKDTGLTAAPQEPKAPKASPVQHALPSSLSVPHTAILVTGAQLCGPAVNLSQIKDTACKSLLGLEEKKHAEAPAGENPPRGPGDARAGSGKAKPPQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 10022 - protein, 808 aa, Homo sapiens
MEEKVAPVKPSRPKRHFSSAGTIESVNLDAIPLAIARLDNSAAKHKLAVKPKKQRVSKKHRRLAQDPQHEQGGLESRPCLDQNGHPGEDKPTWHEEEPNPLDSEEERRRQEDYWRELEAKCKRQKAEAAEKRRLEEQRLQALERRLWEENRRQELLEEEGEGQEPPLEAERAPREEQLCGPAVNLSQIKDTACKSLLGLEEKKHAEAPAGENPPRGPGDARAGSGKAKPPQESPSSASALAEWASIRSRILKNAESDPRSSERDQLRPGDESTPRGRCDSRGNQRKTPPVNAKFSIMPAWQKFSDGGTETSKQSTEAESIRKRPMLGPSEETAPQPPPAGVRELGKGPEKSEMHREPADTTEGCKFAKDLPSFLVPSLPYPPQKVVAHTEFTTSSDSETANGIAKPDPVMPGGEEKASPFGIKLRRTNYSLRFNCDQQAEQKKKKRHSSTGDSADAGPPAAGSARGEKEMEGVALKHGPSLPQERKQAPSTRRDSAEPSSSRSVPVAHPGPPPASSQTPAPEHDKAANKMPLAQKPALAPKPTSQTPPASPLSKLSRPYLVELLSRRAGRPDPEPSEPSKEDQESSDRRPPSPPGPEERKGQKRDEEEEATERKPASPPLPATQQEKPSQTPEAGRKEKPMLQSRHSLDGSKLTEKVETAQPLWITLALQKQKGFREQQATREERKQAREAKQAEKLSKENVSVSVQPGSSSVSRAGSLHKSTALPEEKRPETAVSRLERREQLKKANTLPTSVTVEISDSAPPAPLVKEVTKRFSTPDAAPVSTEPAWLALAKRKAKAWSDCPQIIK

SEQ ID NO: 10023 - protein, 626 aa, Homo sapiens
MPHIGDWWEAVSETVRATFLTLLQDIPSFSPIFLLSTSETMYSELPEEVKCIFRIQYEEVLYIQRPIEEDRRKFFQELILNQASMAPPRRKHAALCAMEVLPLALPSPPRQLSESEKSRMEDQEENTLRELRLFLRDVTKRLATDKRFNIFSKPVDIEEVSDYLEVIKEPMDLSTVITKIDKHNYLTAKDFLKDIDLICSNALEYNPDKDPGDKIIRHRACTLKDTAHAIIAAELDPEFNKLCEEIKEARIKRGLSVTSEQINPHSTGARKTETRVEEAFRHKQRNPMDVWHNSANKCAFRVRRKSRRRSQWGKGIIKKRKVNNLKKDEEDTKFADYENHTEDRKLLENGEFEVSTDCHEENGEETGDLSMTNDESSCDIMDLDQGQRLNNGAGTKENFASTEEESSNESLLVNSSSSLNPEQTSRKETFLKGNCLNGEASTDSFEGIPVLECQNGKLEVVSFCDSGDKCSSEQKILLEDQSKEKPETSTENHGDDLEKLEALECSNNEKLEPGSDVEVKDAELDKEGASKVKKYRKLILEQAKTTSLELVPEEPSEPVPPLIVDRERLKKLLDLLVDKSNNLAVDQLERLYSLLSQCIYRHRKDYDKSQLVEEMERTVHMFETFL

SEQ ID NO: 10024 - protein, 626 aa, Homo sapiens; identical to SEQ ID NO: 10023

SEQ ID NO: 10025 - protein, 621 aa, Homo sapiens
MANVPWAEVCEKFQAALALSRVELHKNPEKEPYKSKYSARALLEEVKALLGPAPEDEDERPEAEDGPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDTPEAEGEVPELYHQRKGEIARCWIKYCLTLMQNAQLSMQDNIGELDLDKQSELRALRKKELDEEESIRKKAVQFGTGELCDAISAVEEKVSYLRPLDFEEARELFLLGQHYVFEAKEFFQIDGYVTDHIEVVQDHSALFKVLAFFETDMERRCKMHKRRIAMLEPLTVDLNPQYYLLVNRQIQFEIAHAYYDMMDLKVAIADRLRDPDSHIVKKINNLNKSALKYYQLFLDSLRDPNKVFPEHIGEDVLRPAMLAKFRVARLYGKIITADPKKELENLATSLEHYKFIVDYCEKHPEAAQEIEVELELSKEMVSLLPTKMERFRTKMALT

SEQ ID NO: 10026 - protein, 577 aa, Homo sapiens
MADVAGPSRPSAAAFWSRDFSDEEQSVVYVPGISAEGNVRSRHKLMSPKADVKLKTSRVTDASISMESLKGTGDSVDEQNSCRGEIKSASLKDLCLEDKRRIANLIKELARVSEEKEVTEERLKAEQESFEKKIRQLEEQNELIIKEREALQLQYRECQELLSLYQKYLSEQQEKLTMSLSELGAARMQEQQVSSRKSTLQCSSVELDGSYLSIARPQTYYQTKQRPKSAVQDSASESLIAFRNNSLKPVTLHHPKDDLDKIPSETTTCNCESPGRKPAVPTEKMPQEELHMKECPHLKPTPSQCCGHRLAADRVHDSHPTNMTPQHPKTHPESCSYCRLSWASLVHGGGALQPIETLKKQISEDRKQQLMLQKMELEIEKERLQHLLAQQETKLLLKQQQLHQSRLDYNCLLKSNCDGWLLGTSSSIKKHQDPPNSGENRKERKTVGFHSHMKDDAQWSCQKKDTCRPQRGTVTGVRKDASTSPMPTGSLKDFVTTASPSLQHTTSRYETSLLDLVQSLSPNSAPKPQRYPSREAGAWNHGTFRLSPLKSTRKKMGMHRTPEELEENQILEDIFFI

SEQ ID NO: 10027 - protein, 2458 aa, Homo sapiens
MISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDRHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSIPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 10028 - protein, 1302 aa, Homo sapiens
MTEVQAMVEFSVELNKFYNVDLFQRGKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELAKANMQLLYERLLRRKQLRTQKDNHLEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPTPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGDLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 10029 - protein, 2071 aa, Homo sapiens
MELAHSLLLNEEALAQITEAKRPVFIFEWLRFLDKVLVAANKTDVKEKQKKLVEQLTGLISSSPGPPTRKLLAKNLAALYSIGDTFTVFQTLDKCNDIIRNKDDTAAYLPTKLAAVACVGAFYEKMGRMLGSAFPETVNNLLKSLKSAESQGRSEILMSLQKVLSGLGGAAASSHRDIYKNARSLLTDRSMAVRCAVAKCLLELQNEAVFMWTAELENIATLCFKALENSNYGVRVAVSKLLGTVMATALMPKQATVMRQNVKRATFDEVLELMATGFLRGGSGFLKSGGEMLKVGGSVNREVRVGVTQAYVVFVTTLGGQWLERSFATFLSHVLDLVSHPRATQTHVEAVYSRRCVSFILRATVGSLLGEKAQIAAAKEICQAIGKQMKAVEAVVNDTSGENKSGAADIAASQHVMVCALQELGSLVQSLNATASPLIQEASIGLLEIVTSVLLHPSMAARLAAAWCLRCVAVALPFQLTPFLDRCAERLNNLKTSPEAVSGYSFAMAALLGGVHQCPLGIPHAKGKMVVSIAEDLLRTAAQNSRLSLQRTQAGWLLLGALMTLGPSVVRYHLPKMLLLWRNVFPRSLKELEAEKARGDSFTWQVTLEGRAGALCAMRSFVAHCPELLTEDVIRKLMTPIECAMTMMSHIPSVMKAHGAHLKASAAMVRLRLYDILALLPPKTYEGSFNALLRELVAEFTLTDNSANTTTSLLRSLCHYDDSVLLGSWLQETDHKSIEDQLQPNSASGSGALEHDPSSIYLRIPAGEAVPGPLPLGVSVIDASVALFGVVFPHVSYKHRLQMLDHFAECVKQAKGVRQQAVQLNIFTAVLSALKGLAENKSTLGPEEVRKSALTLVMGPLDNPNPILRCAAGEALGRMAQVVGEATFIARMAQYSFDKLKSARDVVSRTGHSLALGCLHRYVGGIGSGQHLKTSVSILLALAQDGTSPEVQTWSLHSLALIVDSSGPMYRGYVEPTLSLVLTLLLTVPPSHTEVHQCLGRCLGAIITTVGPELQGNGATTSTIRSSCLVGCAITQDHSDSLVQAAAISCLQQLHMFAPRHVNLSSLVPSLCVHLCSSHLLLRRAAVACLRQLAQREAAEVCEYAMSLAKNTGDKESSSANVSPFAPGVSSRTDIHCRHQGVNITETGLEGLLFGMLDRETDRKLCSDIHDTLGHMLSSLAVEKLSHWLMLCKDVLAASSDMSTATLLSSGKDEEAEKKDEMDDDTMFTTLGEEDKSKPFVAPRWATRVFAADCLCRIINLCENADQAHFDLALARSAKLRNPTNDLLVLHLSDLIRMAFMAATDHSNQLRMAGLQALEDIIKKFASVPEPEFPGHVILEQYQANVGAALRPAFSQDTPSDIIAKACQVCSTWIGSGVVSDLNDLRRVHNLLVSSLDKVQAGKGSSSQLYRESATTMEKLAVLKAWAEVYVVAMNIKKEAESKPKRAIKNTDDDDDDCGTIDELPPDSLITLVQPELPTLSRLWLAALKDYALLTLPAEFSSQLPPDGGAFYTPETIDTARLHYRNSWAPILHAVALWLNSTGFTCSESTEAAAISGLQKRSTSVNLNQASGAVGSAKSLPEINKDRMHLILGVSIQFLCSPRPEEPIEHVTACLQALHTLLDSPYARVHIAEDQLIGVELLSVLHRLLLTWNPSSVQLLVTGVVQQIVRAAQDYLQEKRNTLNEDDMEKEACTVLGEGGDSGGLIPGKSLVFATMELLMFILVRHMPHLSTKVSDSPSHIATKTRLSEESARLVAATVTILSDLPSLCSPAGCMTILPTILFLIARILKDTAIKSADNQVPPPVSAALQGIKSIVTLSMAKTEAGVQKQWTALIRSTLACILEYSQPEDSVPTPDEVSMLTAIALFLWSASNEIIGVQSLQNGCMNRFKNALNSCDPWVQAKCYQLLLSVFQHSNRALSTPYIHSLAPIVVEKLKAVERNRPASNIELLAVQEGIKVLETLVALGEEQNRVQLLALLVPTLISYLLDENSFASASSASKDLHEFALQNLMHIGPLYPHAFKTVMGAAPELKVRLETAVRASQASKAKAAARQPAPAIHSAPTIKLKTSFF

SEQ ID NO: 10030 - protein, 1646 aa, Homo sapiens
MWHGNHVQPGATHRPNQGLEMLQGLGIGMKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMWIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQLFSEGGNFSPKEINSLCSRLEKEAARIELVESVIMLNMEKLENEYLDQANDVINKFESKFHNLSVDLIFIEKIQRLLTNLQVKIKCQVAKSNSQTNGLNFSLQQLQNKIKTCQESRGEKTTVTTEELLSFVQTWKEKLSQRIQYLNCSLDRVSMTELVFTNTILKDQEEDSDILTSSEALEEEAKLDVVTPESFTQLSRVGKPLIEDPAVDVIRKLLQLPNTKWPTHHCDKDPSQTGFKRHRCQPENSGKKAVPSASATSAGSLQTTHPPLSHSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKDKNAQKLHLNLGHPVHFQEMESLHLSEEERQEELDSMIRMNKEKLEECTRRNGQVFITNLATFTEKFLLQLDEVVTIDDVQVARMEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 10031 - protein, 2354 aa, Homo sapiens
MQKRQGYCSYCRVQYNNLEQHLFSAQHRSLTRQSRRQICTSSLMERFLQDVLQHHPYHCQESSSTQDETHVNTGSSSEVVHLDDAFSEEEEEDEDKVEDEDATEERPSEVSEPIEELHSRPHKSQEGTQEVSVRPSVIQKLEKGQQQPLEFVHKIGASVRKCNLVDIGQATNNRSNLVRPPVICNAPASCLPESSNDRPVTANTTSLPPAAHLDSVSKCDPNKVEKYLEQPDGASRNPVPSSHVETTSFSYQKHKESNRKSLRMNSDKLVLWKDVKSQGKTLSAGLKFHERMGTKGSLRVKSPSKLAVNPNKTDMPSNKGIFEDTIAKNHEEFFSNMDCTQEEKHLVFNKTAFWEQKCSVSSEMKFDCISLQSASDQPQETAQDLSLWKEEQIDQEDNYESRGSEMSFDCSSSFHSLTDQSKVSAKEVNLSKEVRTDVQYKNNKSYVSKISSDCDDILHLVTNQSQMIVKEISLQNARHISLVDQSYESSSSETNFDCDASPQSTSDYPQQSVTEVNLPKEVHIGLVDKNYGSSSSEVSADSVFPLQSVVDRPPVAVTETKLRKKAHTSLVDNYGSSCSETSFDCDVSLESVVDHPQLTVKGRNLKGRQVHLKHKKRKPSSAKAHLDCDVSLGTVADESQRAVEKINLLKEKNADLMDMNCESHGPEMGFQADAQLADQSQVAEIERQKVDVDLENKSVQSSRSSLSSDSPASLYHSAHDEPQEALDEVNLKELNIDMEVRSYDCSSSELTFDSDPPLLSVTEQSHLDAEGKERHIDLEDESCESDSSEITFDSDIPLYSVIDQPEVAVYEEETVDLESKSNESCVSEITFDSDIPLHSGNDHPEVAVKEVIQKEEYIHLERKNDEPSGSEISSDSHAPLHSVTNSPEVAVKKLNPQKEEQVHLENKENEPIDSEVSLDYNIIFHSVTGRSEDPIKEISLHTKEHMYLENKSVFETSLDSDVPLQAATHKPEVIVKETWLQREKHAEFQGRSTEFSGSKTSLDSGVPHYSVTEPQVAVNKINRKKQYVLENKNDKCSGSEIILDSNVPPQSMTDQPQLAFLKEKHVNLKDKNSKSGDSKITFDSEQLQEAVKKIDQWKEEVIGLKNKINEPSTYKLIHHPDVSVQSVADQPKVAIKHVNLGNENHMYLEVKNSQYSCSEMNLDSGFLGQSIVNRPQITILEQEHIELEGKHNQCCGSEVSFDSDDPLQSVADRLRETVKEISLWKDEEVDTEDRRNEAKGFEIMYDSDVLQPVAGQPEEVVKEVSLWKEHVDLENKIVKPTDSRINFDSHEPLQSVTNKIPGANKEINLLREEHVCLDDKGYVPSDSEIIYVSNIPLQSVIKQPHILEEEHASLEDKSSNSYSPEESSDSNDSFQAAADELQKPVKEINLWKEDHIYLEDKSYKLGDFDVSYASHIPVQFVTDQSSVPVKEINLQKKDHNDLENKNCEVCGSEIKCHSCVHLQSEVDQPQVSYKEADLQKEEHVVMEEKTDQPSDSEMMYDSDVPFQIVVNQFPGSVKETHLPKVVLVDLVPGDSDYEVISDDIPLQLVTDPPQLTVKDISCINTECIDIEDKSCDFFGSEVRCNCKASTPSMTNQCKETFKIINRKKDYIILGEPSCQSCGSEMNFNVDASDQSMTYESQGPDEKMVKYIDSEDKSCGYNGSKGKFNLEDTSHRTTHRLQKAHKEASLRKDPRNAGLKGKSCQSSASAVDFGASSKSALHRRADKKKRSKLKHRDLEVSCEPDGFEMNFQCAPPLPSDTDQPQETVKKRHPCKKVSSDLKEKNHDSQSSSVLKVDSVRNLKKAKDVIEDNPDEPVLEALPHVPPSFVGKTWSQIMREDDIKINALVKEFREGRFHCYFDDDCETKKVSSKGKKKVTWADLQGKEDTAPTQAVSESDDIVCGISDIDDLSVALDKPCHRHPPAERPPKQKGRVASQCQTAKISHSTQTSCKNYPVMKRKIIRQEEDPPKSKCSRLQDDRKTKKKVKIGTVEFPASCTKVLKPMQPKALVCVLSSLNIKLKEGEGLPFPKMRHHSWDNDIRFICKYKRNIFDYYEPLIKQIVISPPLSVIVPEFERRNWVKIHFNRSNQNSSAGDNDADGQGSASAPLMAVPARYGFNSHQGTSDSSLFLEESKVLHARELPKKRNFQLTFLNHDVVKISPKSVRNKLLESQSKKKIHGKRVTTSSNKLGFPKKVYKPIILQQKPRKASEKQSIWIRTKPSDIIRKYISKYSVFLRHRYQSRSAFLGRYLKKKKSVVSRLKKAKRTAKVLLNSSVPPAGAEELSSAMANPPPKRPVRASCRVARRRKKTDESYHGRQKGPSTPVRAYDLRSSSCLQQRERMMTRLANKLRGNEVK

SEQ ID NO: 10032 - protein, 2354 aa, Homo sapiens; identical to SEQ ID NO: 10031

SEQ ID NO: 10033 - protein, 787 aa, Homo sapiens
MGDPGSEIIESVPPAGPEASESTTDENEDDIQFVSEGPSRPVLEYIDLVCGDDENPSAYYSDILFPKMPKRQGDFLHFLNVKKVKTDTENNEVSKNHCRLSKAKEPHFEYIEQPIIEEKPSLSSKKEIDNLVLPDCWNEKQAFMFTEQYKWLEIKEGKLGCKDCSAVRHLGSKAEKHVHVSKEWIAYLVTPNGSNKTTRQASLRKKIREHDVSKAHGKIQDLLKESTNDSICNLVHKQNNKNIDATVKVFNTVYSLVKHNRPLSDIEGARELQEKNGEVNCLNTRYSATRIAEHIAKEMKMKIFKNIIEENAKICIIIDEASTVSKKTTLVIYLQCTIQSAPAPVMLFVALKELVSTIAECIVNTLLTTLNDCGFTNEYLKANLIAFCSDGANTILGRKSGVATKLLENFPEIIIWNCLNHRLQLSLDDSISEIKQINHLKIFIDKIYSIYHQPNKNQTKLLGTVAKELETEIIKIGRVMGPRWAACSLQAATAVWHAYPILYMHFSHSYSGLAKRLANINFLQDLALMIDILEEFSVLSTALQSRSTNIKKAQKLIKRTIRALENLKIGTGKYESQIEDLIKSDKFKDIPFNKNNKFNALPRSILLDNIIQHMNLRLLSDRNHEDIFNYFDLLEPSTWPYEEITSPWIAGEKTLFHLCKILKYEVDLNDFREFVNNNIKSNNVSIPTTIYKAKKIVSTIAINSAEAERGFNLMNIICTRVRNSLTIDHVSDLMTINLLGKELADWDATPFVKSWSNCNHRLATDTRVRQKSTKVFHENQLAIWNLK

SEQ ID NO: 10034 - protein, 199 aa, Homo sapiens
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYTALLGVWIYGFFVLMLLVLDLLYYSAMNYDICKVYLARWGIQGRWMKQDPRRWGNPARAPRPGQRAPQPQPPPGPLPQAPQAVHTLRGDAHSPPLMTFQSSSA

SEQ ID NO: 10035 - protein, 199 aa, Homo sapiens; identical to SEQ ID NO: 10034

SEQ ID NO: 10036 - protein, 569 aa, Homo sapiens
MGSTLGCHRSIPRDPSDLSHSRKFSAACNFSNILVNQERLNINTATEEELMTLPGVTRAVARSIVEYREYIGGFKKVEDLALVSGVGATKLEQVKFEICVSSKGSSAQHSPSSLRRDLLAEQQPHHLATAVPLTPRVNINTATPAQLMSVRGLSEKMALSIVDFRREHGPFRSVEDLVRMDGINAAFLDRIRHQVFAERSRPPSTHTNGGLTFTAKPHPSPTSLSLQSEDLDLPPGGPTQIISTRPSVEAFGGTRDGRPVLRLATWNLQGCSVEKANNPGVREVVCMTLLENSIKLLAVQELLDREALEKFCTELNQPTLPNIRKWKGPRGCWKAVVAEKPSSQLQKGAGYAGFLWDAAAGMELRDAGSQESSPSNGHGKLAGPSPYLGRFKVGSHDLTLVNLHLAALTLLGSENPSKNHSDGHRLASFAQTLQETLKGEKDVIILGDFGQGPDSNDYDILRKEKFHHLIPAHTFTNISTKNPQGSKSLDNIWISKSLKKVFTGHWAVVREGLTNPWIPDNWSWGGVASEHCPVLAEFYTEKDWSKKDAPRNGSGVALERSEANIKHER

SEQ ID NO: 10037 - protein, 345 aa, Homo sapiens
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRSAYDEPHLLVNIEKQKLELEKRRLDIEAERLQVEKERLQIEKERLRHLDMEHERLQLEKERLQIEREKLRLQIVNSEKPSLENELGQGEKSMLQPQDIETEKLKLERERLQLEKDRLQFLKFESEKLQIEKERLQVEKDRLRIQKEGHLQ

SEQ ID NO: 10038 - protein, 1008 aa, Homo sapiens
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTTEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPRKEDPGSLRKVDPVSSDKVDPVFPRKEEPRYSGKEHPVSSEKVAPTSAEKVDLVLSGKRDPGPSGKADPVPLESMDSASTGKTEPGLLGKLIPGSSGKNGPVSSGTGAPGSLGRLDPTCLGMADPASVGNVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRVEPKAEPVSSTEASSLGQKDLEAAGAERSPCPEAAAPPPGPRTRDNFTKAPSWEASAPPPPREDAGTQAGAQACVSVAVSPMSPQDGAGGSAFSFQAAPRAPSPPSRRDAGLQVSLGAAETRSVATGPMTPQAAAPPAFPEVRVRPGSALAAAVAPPEPAEPVRDVSWDEKGMTWEVYGAAMEVEVLGMAIQKHLERQIEEHGRQGAPAPPPAARAGPGRSGSVRTAPPDGAAKRPPGLFRALLQSVRRPRCCSRAGPTAE

SEQ ID NO: 10039 - protein, 620 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELASMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 10040 - protein, 553 aa, Homo sapiens
MSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 10041 - protein, 553 aa, Homo sapiens; identical to SEQ ID NO: 10040

SEQ ID NO: 10042 - protein, 1278 aa, Homo sapiens
MKAFQRNRSRLKKDYDDFRRQPDHDTFNRELWTTDEGEGDLGKDSPKGEISKSIDSTEPLDILEKDHFDSDDMKLSEIDFPMARSKLLKKELPSKDLPKTLLKTLKRQSKQTDYVDDSTKELSPRKKAKLSTNETTVENLESDVQIDCFSESKHTEPSFPESFASLDSVPVSTLQKGTKPIQALLAKNIGNKVTLTNQLPPSTGRNALAVEKPVLSPPEASPIKPALTCHTNTKGPLQMVYKMPCGQWLPIDLQNSSVKIQVQPMVDPKTGEKIMQQVLILPKNFVIQHKEGKAVAKEVPPLQQKGTEQHCSSFPQTTNINSSLASVFVNSPGTVSTQLPNTAFNKTITPLSNISSARPQPLSPVTSVSNLLTPSVKTSQSEAGKAKNAVSAATFSLPSASPTISSTGQPLSSTTTLNGSTNPGSSFNCFAQQTADSSEAKQELKTVCIRDSQSILVRTRGGNTGVVKVQTNPDQNSPNTVSSSSVFTFAPQLQAFLVPKSTTSSSAFSPVAGTTTTSSLSPFSQTPTSVSIPASFAPSMGKNLKLTLGHTTGSGDLGHVIDKTSHMPSSPLKSSICSSTLLPSTTSSSVSVISISAANFGQNNANIIHTPTKQQQVDYITKSYPVTRSEATAATNGDVISGTPVQKLMLVSAPSILSSGNGTAINMTPALTSTGVSAQKLVFINAPVPSGTSTPTLVAESLKQTLPPPLHKAYVKTPEQPQIVLIPSTVGTPIKINSSPAVSQIKDVKIGLNIGQAIVNTSGTVPAIPSINILQNVTPKGEDKSSKGYILPLSTSGNSVPVSSNFVSQNITPVNESVVSSARAVNVLSVTGANLSLGSFPVTSASASAGAQPPVLVSGNDTSSRIMPILSNRLCSSSLGNTVAISTVKTGHLASSVLISTTQPVVSPKCLTSALQIPVTVALPTPATTSPKIINTVPHSAAVPGATRSVSISKRQSRTSLQFHSPGISTTVPTNVNTNKPQTELSSLSTSPGKITNTSNFASLPNQQALVKTPSYSSAPGGTTIHTASAPSNVTSLVGSQFSEPCIQQKIVINTSTPLAPGTQIMINGTRFIVPPQGLGAGSHVLLISTNPKYGAPLVLNSGQGIQSTPIDNSAQKITLASNNSLSGQPLQHPLRSPTKFINSFGNASSIPTVHTSPQLINTTAKVPVPPPVPTVSLTSVIKSPATLLAKTSLVSAICPSNPPLPSSTSVFHLDPPVKKLLVSPEGAILNTINTPASKVSSLSPSLSQIVVSASRSPASVFPAFQSSGLEKPDRAAS

SEQ ID NO: 10043 - protein, 1770 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDYESKLQALQKQVETRSLAAETTEEEEEEEEVPWTQHEFELAQWAFRKWKSHQFTSLRDLLWGNAVYLKEANAISVELKKKVQFQFVLLTDTLYSPLPPELLPTEMEKTHEDRPFPRTVVAVEVQDLKNGATHYWSLEKLKQRLDLMREMYDRAGEMASSAQDESETTVTGSDPFYDRFHWFKLVGSSPIFHGCVNERLADRTPSPTFSTADSDITELADEQQDEMEDFDDEAFVDDAGSDAGTEEGSDLFSDGHDPFYDRSPWFILVGRAFVYLSNLLYPVPLIHRVAIVSEKGEVRGFLRVAVQAIAADEEAPDYGSGIRQSGTAKISFDNEYFNQSDFSSVAMTRSGLSLEELRIVEGQGQSSEVITPPEEISRINDLDLKSSTLLDGKMVMEGFSEEIGNHLKLGSAFTFRVTVLQASGILPEYADIFCQFNFLHRHDEAFSTEPLKNNGRGSPLAFYHVQNIAVEITESFVDYIKTKPIVFEVFGHYQQHPLHLQGQELNSPPQPCRRFFPPPMPLSKPVPATKLNTMSKTSLGQSMSKYDLLVWFEISELEPTGEYIPAVVDHTAGLPCQGTFLLHQGIQRRITVTIIHEKGSELHWKDVRELVVGRIRNKPEVDEAAVDAILSLNIISAKYLKSSHNSSRTFYRFEAVWDSSLHNSLLLNRVTPYGEKIYMTLSAYLELDHCIQPAVITKDVCMVFYSRDAKISPPRSLRSLFGSGYSKSPDSNRVTGIYELSLCKMSDTGSPGMQRRRRKILDTSVAYVRGEENLAGWRPRGDSLILEHQWELEKLELLHEVEKTRHFLLLRERLGDSIPKSLSDSLSPSLSSGTLSTSTSISSQISTTTFESAITPSESSGYDSGDIESLVDREKELATKCLQLLTHTFNREFSQVHGSVSDCKLSDISPIGRDPSESSFSSATLTPSSTCPSLVDSRSNSLDQKTPEANSRASSPCPEFEQFQIVPAVETPYLARAGKNEFLNLVPDIEEIRPSSVVSKKGYLHFKEPLYSNWAKHFVVVRRPYVFIYNSDKDPVERGIINLSTAQVEYSEDQQAMVKTPNTFAVCTKHRGVLLQALNDKDMNDWLYAFNPLLAGTIRSKLSRRCPSQSKY

SEQ ID NO: 10044 - protein, 1153 aa, Homo sapiens
MSGASVKVAVRVRPFNSRETSKESKCIIQMQGNSTSIINPKNPKEAPKSFSFDYSYWSHTSPEDPCFASQNRVYNDIGKEMLLHAFEGYNVCIFAYGQTGAGKSYTMMGKQEESQAGIIPQLCEELFEKINDNCNEEMSYSVEVSYMEIYCERVRDLLNPKNKGNLRVREHPLLGPYVEDLSKLAVTSYTDIADLMDAGNKARTVAATNMNETSSRSHAVFTIVFTQKKHDNETNLSTEKVSKISLVDLAGSERADSTGAKGTRLKEGANINKSLTTLGKVISALAEVSKKKKKTDFIPYRDSVLTWLLRENLGGNSRTAMVAALSPADINYDETLSTLRYADRAKQIKCNAVINEDPNAKLVRELKEEVTRLKDLLRAQGLGDIIDTSMGSLTSSPSSCSLSSQVGLTSVTSIQERIMSTPGGEEAIERLKESEKIIAELNETWEEKLRKTEAIRMEREALLAEMGVAIREDGGTLGVFSPKKTPHLVNLNEDPLMSECLLYYIKDGITRVGQADAERRQDIVLSGAHIKEEHCIFRSERSNSGEVIVTLEPCERSETYVNGKRVSQPVQLRSGNRIIMGKNHVFRFNHPEQARAEREKTPSAETPSEPVDWTFAQRELLEKQGIDMKQEMEKRLQEMEILYKKEKEEADLLLEQQRLDADSDSGDDSDKRSCEESWKLITSLREKLPPSKLQTIVKKCGLPSSGKKREPIKMYQIPQRRRLSKDSKWVTISDLKIQAVKEICYEVALNDFRHSRQEIEALAIVKMKELCAMYGKKDPNERDSWRAVARDVWDTVGVGDEKIEDVMATGKGSTDVDDLKVHIDKLEDILQEVKKQNNMKDEEIKVLRNKMLKMEKVLPLIGSQEQKSPGSHKAKEPVGAGVSSTSENNVSKGDNGELAKEERVSQLMNGDPAFRRGRLRWMRQEQIRFKNLQQQEITKQLRRQNVPHRFIPPENRKPRFPFKSNPKHRNSWSPGTHIIITEDEVIELRIPKDDEARKGNKEESQEKGGKGAFKDPQFPWGSQGMRSQDHIQVSKQHINNQQQPPQLRWRSNSLNNGQPKSTRCQASASAESLNSHSGHPTADVQTFQAKRHIHQHRQSYCNYNTGGQLEGNAATSYQKQTDKPSHCSQFVTPPRMRRQFSAPNLKAGRETTV

SEQ ID NO: 10045 - protein, 1624 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDGTPPSSEYETLTAKFHFVDLAGSERLKRTGATGERAKEGISINCGLLALGNVISALGDQSKKVVHVPYRDSKLTRLLQDSLGGNSQTIMIACVSPSDRDFMETLNTLKYANRARNIKNKVVVNQDKTSQQISALRAEIARLQMELMEYKAGKRVIGEDGAEGYSDLFRENAMLQKENGALRLRVKAMQEAIDAINNRVTQLMSQEANLLLAKAGDGNEAIGALIQNYIREIEELRTKLLESEAMNESLRRSLSRASARSPYSLGASPAAPAFGGSPASSMEDASEVIRRAKQDLERLKKKEVRQRRKSPEKEAFKKRAKLQQENSEETDENEAEEEEEERDESGCEEEEGREDEDEDSGSEESLVDSDSDPEEKEVNFQADLADLTCEIEIKQKLIDELENSQRRLQTLKHQYEEKLILLQNKIRDTQLERDRVLQNLSTMECYTEEKANKIKADYEKRLREMNRDLQKLQAAQKEHARLLKNQSRYERELKKLQAEVAEMKKAKVALMKQMREEQQRRRLVETKRNREIAQLKKEQRRQEFQIRALESQKRQQEMVLRRKTQEVSALRRLAKPMSERVAGRAGLKPPMLDSGAEVSASTTSSEAESGARSVSSIVRQWNRKINHFLGDHPAPTVNGTRPARKKFQKKGASQSFSKAARLKWQSLERRIIDIVMQRMTIVNLEADMERLIKKREELFLLQEALRRKRERLQAESPEEEKGLQELAEEIEVLAANIDYINDGITDCQATIVQLEETKEELDSTDTSVVISSCSLAEARLLLDNFLKASIDKGLQVAQKEAQIRLLEGRLRQTDMAGSSQNHLLLDALREKAEAHPELQALIYNVQQENGYASTDEEISEFSEGSFSQSFTMKGSTSHDDFKFKSEPKLSAQMKAVSAECLGPPLDISTKNITKSLASLVEIKEDGVGFSVRDPYYRDRVSRTVSLPTRGSTFPRQSRATETSPLTRRKSYDRGQPIRSTDVGFTPPSSPPTRPRNDRNVFSRLTSNQSQGSALDKGIISPVGGAKGARTAPLQCVSMAEGHTKPILCLDATDELLFTGSKDRSCKMWNLVTGQEIAALKGHPNNVVSIKYCSHSGLVFSVSTSYIKVWDIRDSAKCIRTLTSSGQVISGDACAATSTRAITSAQGEHQINQIALSPSGTMLYAASGNAVRIWELSRFQPVGKLTGHIGPVMCLTVTQTASQHDLVVTGSKDHYVKMFELGECVTGTIGPTHNFEPPHYDGIECLAIQGDILFSGSRDNGIKKWDLDQQELIQQIPNAHKDWVCALAFIPGRPMLLSACRAGVIKVWNVDNFTPIGEIKGHDSPINAICTNAKHIFTASSDCRVKLWNYVPGLTPCLPRRVLAIKGRATTLP

SEQ ID NO: 10046 - protein, 593 aa, Homo sapiens
MGQGLKAWPRYRVVGSADAGQYNLEITDAELSDDASYECQATEAALRSRRAKLTVLNPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 10047 - protein, 1012 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 10048 - protein, 549 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVSQLTKPISSLTKPYH

SEQ ID NO: 10049 - protein, 269 aa, Homo sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQE

SEQ ID NO: 10050 - protein, 505 aa, Homo sapiens
MSAEEMVQIRLEDRCYPVSKRKLIEQSDYFRALYRSGMREALSQEAGGPEVQQLRGLSAPGLRLVLDFINAGGAREGWLLGPRGEKGGGVDEDEEMDEVSLLSELVEAASFLQVTSLLQLLLSQVRLNNCLEMYRLAQVYGLPDLQEACLRFMVVHFHEVLCKPQFHLLGSPPQAPGDVSLKQRLREARMTGTPVLVALGDFLGGPLAPHPYQGEPPSMLRYEEMTERWFPLANNLPPDLVNVRGYGSAILDNYLFIVGGYRITSQEISAAHSYNPSTNEWLQVASMNQKRSNFKLVAVNSKLYAIGGQAVSNVECYNPEQDAWNFVAPLPNPLAEFSACECKGKIYVIGGYTTRDRNMNILQYCPSSDMWTLFETCDVHIRKQQMVSVEETIYIVGGCLHELGPNRRSSQSEDMLTVQSYNTVTRQWLYLKENTSKSGLNLTCALHNDGIYIMSRDVTLSTSLEHRVFLKYNIFSDSWEAFRRFPAFGHNLLVSSLYLPNKAET

SEQ ID NO: 10051 - protein, 574 aa, Homo sapiens
MVEDGAEELEDLVHFSVSELPSRGYGVMEEIRRQGKLCDVTLKIGDHKFSAHRIVLAASIPYFHAMFTNDMMECKQDEIVMQGMDPSALEALINFAYNGNLAIDQQNVQSLLMGASFLQLQSIKDACCTFLRERLHPKNCLGVRQFAETMMCAVLYDAANSFIHQHFVEVSMSEEFLALPLEDVLELVSRDELNVKSEEQVFEAALAWVRYDREQRGPYLPELLSNIRLPLCRPQFLSDRVQQDDLVRCCHKCRDLVDEAKDYHLMPERRPHLPAFRTRPRCCTSIAGLIYAVGGLNSAGDSLNVVEVFDPIANCWERCRPMTTARSRVGVAVVNGLLYAIGGYDGQLRLSTVEAYNPETDTWTRVGSMNSKRSAMGTVVLDGQIYVCGGYDGNSSLSSVETYSPETDKWTVVTSMSSNRSAAGVTVFEGRIYVSGGHDGLQIFSSVEHYNHHTATWHPAAGMLNKRCRHGAASLGSKMFVCGGYDGSGFLSIAEMYSSVADQWCLIVPMHTRRSRVSLVASCGRLYAVGGYDGQSNLSSVEMYDPETDCWTFMAPMACHEGGVGVGCIPLLTI

SEQ ID NO: 10052 - protein, 620 aa, Homo sapiens
MASDSMSSKQARNHITKGKRQQQHQQIKNRSSISDGDGEDSFIFEANEAWKDFHGSLLRFYENGELCDVTLKVGSKLISCHKLVLACVIPYFRAMFLSEMAEAKQTLIEIRDFDGDAIEDLVKFVYSSRLTLTVDNVQPLLYAACILQVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSPLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 10053 - protein, 762 aa, Homo sapiens
MNEAKVKETLRRCGASGDECGRLQYALTCLRKVTGLGGEHKEDSSWSSLDARRESGSGPSTDTLSAASLPWPPGSSQLGRAGNSAQGPRSISVSALPASDSPTPSFSEGLSDTCIPLHASGRLTPRALHSFITPPTTPQLRRHTKLKPPRTPPPPSRKVFQLLPSFPTLTRSKSHESQLGNRIDDVSSMRFDLSHGSPQMVRRDIGLSVTHRFSTKSWLSQVCHVCQKSMIFGVKCKHCRLKCHNKCTKEAPACRISFLPLTRLRRTESVPSDINNPVDRAAEPHFGTLPKALTKKEHPPAMNHLDSSSNPSSTTSSTPSSPAPFPTSSNPSSATTPPNPSPGQRDSRFNFPAAYFIHHRQQFIFPVPSAGHCWKCLLIAESLKENAFNISAFAHAAPLPEAADGTRLDDQPKADVLEAHEAEAEEPEAGKSEAEDDEDEVDDLPSSRRPWRGPISRKASQTSVYLQEWDIPFEQVELGEPIGQGRWGRVHRGRWHGEVAIRLLEMDGHNQDHLKLFKKEVMNYRQTRHENVVLFMGACMNPPHLAIITSFCKGRTLHSFVRDPKTSLDINKTRQIAQEIIKGMGYLHAKGIVHKDLKSKNVFYDNGKVVITDFGLFGISGVVREGRRENQLKLSHDWLCYLAPEIVREMTPGKDEDQLPFSKAADVYAFGTVWYELQARDWPLKNQAAEASIWQIGSGEGMKRVLTSVSLGKEVSEILSACWAFDLQERPSFSLLMDMLEKLPKLNRRLSHPGHFWKSAEL

SEQ ID NO: 10054 - protein, 686 aa, Homo sapiens
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 10055 - protein, 332 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 10056 - protein, 270 aa, Homo sapiens
MAPWGKRLAGVRGVLLDISGVLYDSGAGGGTAIAGSVEAVARLKRSRLKVRFCTNESQKSRAELVGQLQRLGFDISEQEVTAPAPAACQILKERGLRPYLLIHDGVRSEFDQIDTSNPNCVVIADAGESFSYQNMNNAFQVLMELEKPVLISLGRGRYYKETSGLMLDVGPYMKALEYACGIKAEVVGKPSPEFFKSALQAIGVEAHQAVMIGDDIVGDVGGAQRCGMRALQVRTGKFRPSDEHHPEVKADGYVDNLAEAVDLLLQHADK

SEQ ID NO: 10057 - protein, 390 aa, Homo sapiens
MMQSATVPAEGAVKGLPEMLGVPMQQIPQCAGCNQHILDKFILKVLDRHWHSSCLKCADCQMQLADRCFSRAGSVYCKEDFFKRFGTKCTACQQGIPPTQVVRKAQDFVYHLHCFACIICNRQLATGDEFYLMEDGRLVCKEDYETAKQNDDSEAGAKRPRTTITAKQLETLKNAYKNSPKPARHVREQLSSETGLDMRVVQVWFQNRRAKEKRLKKDAGRHRWGQFYKSVKRSRGSSKQEKESSAEDCGVSDSELSFREDQILSELGHTNRIYGNVGDVTGGQLMNGSFSMDGTGQSYQDLRDGSPYGIPQSPSSISSLPSHAPLLNGLDYTVDSNLGIIAHAGQGVSQTLRAMAGGPTSDISTGSSVGYPDFPTSPGSWLDEMDHPPF

SEQ ID NO: 10058 - protein, 647 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 10059 - protein, 305 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVFARTWVALSPSA

SEQ ID NO: 10060 - protein, 499 aa, Homo sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQLKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 10061 - protein, 632 aa, Homo sapiens
MKALLLLVLPWLSPANYIDNVGNLHFLYSELCKGAFHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 10062 - protein, 123 aa, Homo sapiens
MNPVYSPGSSGVPYANAKGIGYPAGFPMGYAAAAPAYSPNMYPGANPTFQTGYTPGTPYKVSCSPTSGAVPPYSSSPQAVPMSPCADQWARQLGQISGQPFVLLAGLLCWPHGEALESLMDCN

SEQ ID NO: 10063 - protein, 114 aa, Homo sapiens
MIRSQGPVSFEDVAVDFTQEEWQQLDYAQRTLYRDVMLEIYSHLVSMGYPVSKPDVISKLEQGEEPWIIKRHIPNWIYPERVDLTPLNWIYLEMFSSIRRHWKVLQGVIHCTPF

SEQ ID NO: 10064 - protein, 131 aa, Homo sapiens
MIRSQGPVSFEDVAVDFTQEEWQQLDYAQRTLYRDVMLEIYSHLVSMGYPVSKPDVISKLEQGEEPWIIKRHIPNWIYPDRESRLDTPQLDIFRDVFFHKETLESITRGHSLYSILKVWQGDDQLERDQEN

SEQ ID NO: 10065 - protein, 90 aa, Homo sapiens
MIRSQGPVSFEDVAVDFTQEEWQQLDYAQRTLYRDVMLEIYSHLVSMGYPVSKPDVISKLEQGEEPWIIKRHIPNWIYPGENVADGRQEK

SEQ ID NO: 10066 - protein, 131 aa, Homo sapiens; identical to SEQ ID NO: 10064

SEQ ID NO: 10067 - protein, 131 aa, Homo sapiens; identical to SEQ ID NO: 10064

SEQ ID NO: 10068 - protein, 114 aa, Homo sapiens; identical to SEQ ID NO: 10063

SEQ ID NO: 10069 - protein, 90 aa, Homo sapiens; identical to SEQ ID NO: 10065

SEQ ID NO: 10070 - protein, 131 aa, Homo sapiens; identical to SEQ ID NO: 10064

SEQ ID NO: 10071 - protein, 381 aa, Homo sapiens
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPAPPPGLRGTLDLQVIRVRMEEPPAVSLLQDWSRHPQGTKRVGAGDTSDWPTVLSESSTTVAGKPEKGNGV

SEQ ID NO: 10072 - protein, 157 aa, Homo sapiens
MELPQSRFSWKQRKAQLPGRRHNASYCLCHFPSSLPAFLRLLGSHCPVQELFADAQPRLPKLPREVVSVHSHCFQTSRANWGGEARPRESSKRPSLQHRPPAAGVGSWVAGGQLVPALLDMSRVGAEARVALIHNEAPGRGSRGPRSLEEDRGWIIQ

SEQ ID NO: 10073 - protein, 281 aa, Homo sapiens
MAEAAPARDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGLALRTDLQGEAQI

SEQ ID NO: 10074 - protein, 184 aa, Homo sapiens
MCPLFSCQWEGRLEVVVPHLRQIHRVDILQGAEIVFLATDMHLPAPADWIIMHSCLGHHFLLVLRKQERHEGHPQFFATMMLIGTPTQADCFTYRLEDIVLVQLGDTRVTGMENGDGGGARSVGPKSRAGRGMEWGDAGGRCLGLGNGVVSGTPVGTVLEGSPEWAAARSEHLAAGDGQGRRIA

SEQ ID NO: 10075 - protein, 101 aa, Homo sapiens
MGGRPGPREGRNAVPSRRLRWVAAAAPGVCSARGRSERTAPSEQVPAARRAHTLASPQRPKVTTVPGGFALLEKCILTVEFRRRESVNSPYHVDSPVWSRI

SEQ ID NO: 10076 - protein, 101 aa, Homo sapiens; identical to SEQ ID NO: 10075

SEQ ID NO: 10077 - protein, 72 aa, Homo sapiens
MSGAGLAAVVSCLRPQPGEEPQTHEDLLLAAAYVLDAQYNRNVPFETHLRPSDVTIFITTRQRRLPHTSLFV

SEQ ID NO: 10078 - protein, 247 aa, Homo sapiens
MLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFSLFFFCNTATVYKICAWMQLLAALCLVLGCMIFPDGWDAETIRDMCGAKTGKYSLGDCSVRWAYILAIIGILNALILSFLAFVLGNRQTDLLQEELKPENKDFVGSTVSSVLRPGGDVSGWGVLPCPVAHSQGP

SEQ ID NO: 10079 - protein, 263 aa, Homo sapiens
MSLAPRFWSWDHISPLQLLTRTWELRLGVCPRVPAPQATPPGPRRGRGPADATVGTMRQPAVRLVRLGRVPYAELLGLQDRWLRRLQAEPGIEAPSGTEAGALLLCEPAGPVYTAGLRGGLTPEETARLRALGAEVRVTGRGGLATFHGPGQLLCHPVLDLRRLGLRLRMHVASLEACAVRLCELQGLQDARARPPPYTGVWLDDRKICAIGERRGAGRYLRAEESAVEGTSHPTAWLSTALPTSRGLSTSCPVDWLGQASLP

SEQ ID NO: 10080 - protein, 80 aa, Homo sapiens
MQEMVRELWMWNVEEEEHEVGICTWGGQHCGCPAKSLPGPHPGGVSAPQSASQLMVKLLVWQKSVHKLRKNRNAYSCGPL

SEQ ID NO: 10081 - protein, 105 aa, Homo sapiens
MDEKAGWPGSESLSTSSERGHGPAVGNLVSESAGRSAGQGSPGPDAMSRNLRTALIFGGFISLIGAAFYPIYFRPLMRLEEYRLSVSSSVNVCGYVIYAKMPSLL

SEQ ID NO: 10082 - protein, 140 aa, Homo sapiens
MHRGVGPAFRVVRKMAASGAEPQVLVQYLVLRKDLSQAPFSWPAGALVAQACHAATAALHTHRDHPHTAAYLQELGRMRKVVLEAPDETTLKELAETLQQKNIDHMLWLEQPENIATCIALRPYPKEEVGQYLKKFRLFK

SEQ ID NO: 10083 - protein, 317 aa, Homo sapiens
MLCPRLPFLPRRRLQSLAEAHRPGPFPPVPNPCRRGRPGALRRRRSLGAPHPSWLWRGAGLTAKPSPPPALERSAELSLGRCPSPHPGIILCGSPRDPGAGRGPSTAAGTHPAPERRRPPQDERSPGRRGKPRRWMCATARSPGAPGRKHPRQAGGEKKEAGRPTPTQPAALRWAPGRPSAAGAAPGTHWARAPRTPARRLRGEPWALGALAKTGEWASRVLLCEGQGKGVVARCLAEPSPFPTLSLTRPPVKGSEAQMSRAILNVRSCRPSATVTCASSAPQAPPLVSVTTGSPGGQMIAREFFGVRRFCCEKGED

SEQ ID NO: 10084 - protein, 183 aa, Homo sapiens
MAVGKNKCLTKGGKKGAKKKVVDQFSKKDWYDVKASAMFSIRNIGKTLVTRTQGTKIASDGLKGRVFEVSLADLQNDEVAFRKFKLITEDVQGKNCLSNFHGMDLTRDKMCSMVKKWQTMIEAHVDVRTTDGYLLHLFCVGFTKKRNNQIRKTSYAQHQQVRQIRKKMMEIMTPEVQTNYSGQ

SEQ ID NO: 10085 - protein, 227 aa, Homo sapiens
MAVGKNKCLTKGGKKGAKKKVVDQFSKKDWYDVKASAMFSIRNIGKTLVTRTQGTKIASDGLKGRVFEVSLADLQNDEVAFRKFKLITEDVQGKNCLSNFHGMDLTRDKMCSMVKKWQTMIEAHVDVRTTDGYLLHLFCVGFTKKRNNQIRKTSYAQHQQVRQIRKKMMEIMTPEVQTNDLKDPEFELGKLMELHGEGSSSGRATGDETSAKVERADGYEPPVQESV

SEQ ID NO: 10086 - protein, 133 aa, Homo sapiens
MAVGKNKCLTKGGKKGAKKKVVDQFSKKDWYDVKASAMFSIRNIGKTLVTRTQGTKIASDGLKGRVFETMIEAHVDVRTTDGYLLHLFCVGFTKKRNNQIRKTSYAQHQQVRQIRKKMMEIMTPEVQTNYSGQ

SEQ ID NO: 10087 - protein, 183 aa, Homo sapiens; identical to SEQ ID NO: 10084

SEQ ID NO: 10088 - protein, 183 aa, Homo sapiens; identical to SEQ ID NO: 10084

SEQ ID NO: 10089 - protein, 183 aa, Homo sapiens; identical to SEQ ID NO: 10084

SEQ ID NO: 10090 - protein, 106 aa, Homo sapiens [sequence omitted]

SEQ ID NO: 10091 - protein, 141 aa, Homo sapiens
MDIPVPSSFNDVGQDWRLRHFVDQMWYEREVTFLEQWTQDLHTRVVLRIVSAHSYAIVWVNGVDALEHEGSTSPLTPTSVACSRWGPCPPASASLSPSATCSSPPPCHQGASSTWPTPPRGYHPASTADTHLRVPPRGALH

SEQ ID NO: 10092 - protein, 174 aa, Homo sapiens
MEHRSCRITENLLGVVLTPLMSSVWVLHSQVPAQGTCWQWQEADVGCRAIGLVNYQISVKCSNQFKLEVYLLNAENKVVDNQAGTQGQLKVLGTNLWWPYLMHEHPAYLYSWEVWLTAQKSLGPLTSTHSLWGSALWPSPRASSSSVGNLSISTASTSMRMRTSKGRASTVRCW

SEQ ID NO: 10093 - protein, 114 aa, Homo sapiens
MLPVSVCRLATQLLHQYPILSSTGTNESWPCLWRRITPSHSLKRSRPSWLIHLPLWLLPLWLLPPQLLLLLLQPQLRLKPRKSRRSRTRIWDLVSLTNHQKATNLASFICKTRK

SEQ ID NO: 10094 - protein, 114 aa, Homo sapiens; identical to SEQ ID NO: 10093

SEQ ID NO: 10095 - protein, 137 aa, Homo sapiens
MDLSLNTPCLVFSHSDVTISTCHVSAKVGTRLVFDHDGKIIQKTPYPHPRGTTVSVKQLFSTLPVRHKEFQRNIKKKRACFPFAFCRDCQFLEGSPAMLPVQPAKLTPRSTPPHPCSLEDNVITVFSSVKNGPGSSR

SEQ ID NO: 10096 - protein, 147 aa, Homo sapiens
MDLIEVSGNGCGVEEENFEGLTLKHHTSKIREFADLTRVETFGFRGKALSSLCALSDVTISTCHVSAKVGTRLVFDHDGKIIQKTPYPHPRGTTVSVKQLFSTLPVRHKEFQRNIKKKRACFPFAFCRDCQFLEGSPAMLPVQPAKL

SEQ ID NO: 10097 - protein, 147 aa, Homo sapiens; identical to SEQ ID NO: 10096

SEQ ID NO: 10098 - protein, 137 aa, Homo sapiens; identical to SEQ ID NO: 10095

SEQ ID NO: 10099 - protein, 225 aa, Homo sapiens
MLQQQECRFLYPRKEGQSVENKPKNHYKNILPFILLNEDDSGPGADYIRTDPEEEPGHGRGRVDIPCGPAPPHLHLHSPRGPAPPQLKCTTMGPARGSRLAALGPVHLVPEAEDAGGIGPDAVVRPAEGCLQGCLQATVAAFWATVHQENTRVIVMTTREMERGRRSPRNKCFRDWPELPGSQEFGRVHMRVLGKGQAQGYCVRELQVWRPGQVSLAAVERACCT

SEQ ID NO: 10100 - protein, 270 aa, Homo sapiens
MQKHYTVAWFLYSAPGVDPSPPCRSLGWKRKREWSDESAEEPEKELAPEPEETWVVEMLCGLKMKLKQQRVSPILPEHHKGFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYGKNRSRIPLLRKPSVPVRPFHEPEGQEEPLSHTLAP

SEQ ID NO: 10101 - protein, 270 aa, Homo sapiens; identical to SEQ ID NO: 10100

SEQ ID NO: 10102 - protein, 251 aa, Homo sapiens
MERLSAAPVKGQTGPERPSPFSQLVYTNNDSYVIHHGDLRKIHKAASRGQAWKLERMMKKTTMDLNIRDAKERTALYWACANGHAEVVTLLVDRKCQLDVLDGENRTILMKALQCQREACANILIDSGADPNIVDVYGNTAVHYAVNSENLSVVAKLLSCGADIEVKNKAGHTPLLLAIRKRSEEIVEFLLTKNANANAVDKFKCTALMLAICHGSSEIVGKLLQQNVDICAEATCGMIAERYAVACGFNL

SEQ ID NO: 10103 - protein, 370 aa, Homo sapiens
MSRRKQTNPNKVHCDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 10104 - protein, 122 aa, Homo sapiens
MTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 10105 - protein, 130 aa, Homo sapiens [sequence omitted]

SEQ ID NO: 10106 - protein, 68 aa, Homo sapiens [sequence omitted]

SEQ ID NO: 10107 - protein, 130 aa, Homo sapiens [sequence omitted]

SEQ ID NO: 10108 - protein, 88 aa, Homo sapiens
MEPVEPQYQLVNAESTSPFLHCLREVIGEYSVHEFSLLGKTESQGIGLWIALVVFLSFLIFSTSFYISNAEQPFFKGPPTEAAKELSL

SEQ ID NO: 10109 - protein, 49 aa, Homo sapiens
MNFTRKSSFFLELDDISCSSESEQVKLLLFSDHNQLSRKRDRRNQEKGE

SEQ ID NO: 10110 - protein, 435 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILV

SEQ ID NO: 10111 - protein, 194 aa, Homo sapiens
MPASLLAGVKGAGISEVSWAESPEWEEVAGRGSEEENRGPGGLCFFPDTGAVEETSAADARGASRPRQSWDLGLSCCASIVGALETGGPPEVPVASEDKVWEGREGLQSGMALSSTCSALLMRWNAVSFSRCRSSAVTRYPSSKGGGSIKGSPRLRGSRGILRLRGLESWDLGEPPVGAIVCPGAVSAPFSHRV

SEQ ID NO: 10112 - protein, 194 aa, Homo sapiens; identical to SEQ ID NO: 10111

SEQ ID NO: 10113 - protein, 194 aa, Homo sapiens; identical to SEQ ID NO: 10111

SEQ ID NO: 10114 - protein, 64 aa, Homo sapiens
MNLLHTKETRSSIITSSNIARENLDTEKTSSVLNVKIYLHIQNQSIIQENVLSSVSYHWHNEHQ

SEQ ID NO: 10115 - protein, 94 aa, Homo sapiens
MNLLHTKETRSSIITSSNIARENLDTEKTSSVLNVKIYLHIQNQSIIQNFQCHVNRYKDHELSCIASDFKNNVSRNPAENVLSSVSYHWHNEHQ

SEQ ID NO: 10116 - protein, 205 aa, Homo sapiens
MGFSLSPTWKAEPCLVDLGSGITPYDSEGLILSEREAGQPGCGGNGVPLLMPVAVFVHLHVTLAEMNATWNPTHRSRLPHAREKTALPVLAWLCVGLYLLTGPQLARALEQLWGPRPGQESQLRTRRTEEDGVGKSSSLPYPRPLPASTEGRTAIVPPYLEALICTKLARAEFSANKDSARRHFRKVADRWLEAGLGESTAEKHF

SEQ ID NO: 10117 - protein, 130 aa, Homo sapiens
MSTKCQALSQALGRQRGRESFFVPTPCCLADERSYQGLGLSAGVKVRVPRSASTHLAFLFLAPSWPKYFSIVALITLTEVSFPRPFEEQNSHTLLSLNPLSPASSGLPLSMGHLELVSTAEQTRNKHLPC

SEQ ID NO: 10118 - protein, 454 aa, Homo sapiens
MESTPGEDVVKIVKITKDLGYYMNLVDKASAGNFHSPPIYSNHHPDQSAAINMQQRRARERLPSRGSTAGGQLCQLTVWDLALGAAAFPRLEPVCGGGRRARGSGLGPGLRLRPRGCGSPAPPAGALGGRGKVLTGWLDPWQNPVPDSRLEGSGLLVCRSEGEKDSNPGQVYGCLRYWNRRRSIPVGDNTVALFWDEQGVKHPHPRNPPSGTSSFNQENKKLNEQQPQQLALSSWVRRGQWGRTVPQREVEALSIWPRQDPWGPCVRRELCKTFTSEGKCSVLGIWGVLKPPLRVPHPHPHLPGARRFPLQGLEWTRLPSRHYTASPAGGGKGPAATRRTRVLHFSYLQVGAICAKPRGCNEEQNGAATAGSKSGKHNGEMDLENWKESFPQERAAESLHLVAAGVPSTESVGAEASPDPSHGQCPPVLKSCSGGGVSVPPPLPSLLLGLSDLA

SEQ ID NO: 10119 - protein, 297 aa, Homo sapiens
MIQEDLKEASACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 10120 - protein, 68 aa, Homo sapiens [sequence omitted]

SEQ ID NO: 10121 - protein, 179 aa, Homo sapiens
MRRPRLPAQASGSKACVPGIRGGHFSIPSFRATTWVRRGDVGSYVCGTAPAKLKNESSGHSGRQPTSLWLRPRGGAAARAAAGLNSEKPGWVWLSRCVGLRGGGRVDAAELRPEVGDRRWGTTESDVWRVRLRVGGRAGTAATREPGASWVRVTHEPAPSRGPGVCEEPWRRPPASRFF

SEQ ID NO: 10122 - protein, 310 aa, Homo sapiens
MHTEDLSLSLDRSPPSCSHEGQLLRLHSSLLSYTRTVTLLTYYPDAEPSILPLSIHLAPPTPLAFVCSKFTPTITSRIKACIYQVKEGNQRLQESLHRIAWPRPLLDFTCRCGPGVGGRRLSSFPHPPALSPERGIEPERGEGVSSSSKTPIHDSYPLTPPTRLPPSTLLLFGRERRRERNQKPLSNTDPLLLLLLLLLLLLLLLLLLLLLLLLLGPGWRHLTTPRSSHFPSSPPPPSPPPPPLPPFITLCVILHSSREGTQKWGAGKTIINFPVFYGYEDLLLVISGTPMKSARKPISNLCTFANLSGF

SEQ ID NO: 10123 - protein, 297 aa, Homo sapiens; identical to SEQ ID NO: 10119

SEQ ID NO: 10124 - protein, 407 aa, Homo sapiens
MESTPGEDVVKIVKITKDLGYYMNLVDKASAGNFHSPPIYSNHHPDQSAAINMQQRRARERLPSRGSTAGGQLCQLTVWDLALGAAAFPRLEPVCGGGRRARGSGLGPGLRLRPRGCGSPAPPAGALGGRGKVLTGWLDPWQNPVPDSRLEGSGLLVCRSEGEKDSNPGQVYGCLRYWNRRRSIPVGDNTVALFWDEQGVKHPHPRNPPSGTSSFNQENKKLNEQQPQQLALSSWVRRGQWGRTVPQREVEALSIWPRQDPWGPCVRRELCKTFTSEGKCSVLGIWGVLKPPLRVPHPHPHLPGARRFPLQGLEWTRLPSRHYTASPAGGGKGPAATRRTRVLHFRCDASASDQLTATHLKSHLGLPENQMNLRVWQSISISSQICVASYRALWLWKAFAFTYAVII

SEQ ID NO: 10125 - protein, 71 aa, Homo sapiens
MGKNAKKIRAQLTEQMKCLDQQCELRVQLLQDLQDFFRKKAEIEMDYSRNLEKLAERFLAKTRSTKDQQFK

SEQ ID NO: 10126 - protein, 64 aa, Homo sapiens; identical to SEQ ID NO: 10114

SEQ ID NO: 10127 - protein, 94 aa, Homo sapiens; identical to SEQ ID NO: 10115

SEQ ID NO: 10128 - protein, 205 aa, Homo sapiens; identical to SEQ ID NO: 10116

SEQ ID NO: 10129 - protein, 86 aa, Homo sapiens
MKTKSSDDLLAGMARGVTVTNGVKGKESSCPSAAPSASAPAMTTVENKSKISTGNCRHTKVDGLIFQPNTLITLITIISSQPVVTL

SEQ ID NO: 10130 - protein, 310 aa, Homo sapiens; identical to SEQ ID NO: 10122

SEQ ID NO: 10131 - protein, 179 aa, Homo sapiens; identical to SEQ ID NO: 10121

SEQ ID NO: 10132 - protein, 130 aa, Homo sapiens; identical to SEQ ID NO: 10117

SEQ ID NO: 10133 - protein, 49 aa, Homo sapiens; identical to SEQ ID NO: 10109

SEQ ID NO: 10134 - protein, 578 aa, Homo sapiens
MKKLRYWDLKSGVCTRIFGGHQGTITCMDLCKNRLVSGGRDCQVKVWDVDTGKCLKTFRHKDPILATRINDTYIVSSCERGLVKVWHIAMAQLVKTLSGHEGAVKCLFFDQWHLLSGSTDGLVMAWSMVGKYERCLMAFKHPKEVLDVSLLFLRVISACADGKIRIYNFFNGNCMKVIKANGRGDPVLSFFIQGNRMVVNTESNVLMFQFEHIKWQYAVEKTKQKKNKEKEEEKEENSLMEILSKCNIQVHSPRESVSSKQTVIQELLPGKPPKSRVLLKPAKFSSAVLIEELQSQGKSKSPRRDDDVEKAQKQGQLETPGKLPSHPKKKSWKIPMSPDQFLLTVSALQHARNSGEFAYPCRPQTEITDVWGPSISYPRKVLNFKGKSIQRAVDRLRLSNPPIDVKRTSIPLEIQKLQPNLKISLHSPRAQSTIPQPMIIRSRFSGSLKGGDQVTSSIERAVCSTGPLTSMQVIKPNRMLAPQVGTATLSLKKERPRIYTALDPFRVNAEFVLLTVKEEKEHQEAKMKEYQARESTGVVDPGKASKAAWIRKIKGLPIDNFTKQGKTAAPELGQNVFI

SEQ ID NO: 10135 - protein, 130 aa, Homo sapiens [sequence omitted]

SEQ ID NO: 10136 - protein, 68 aa, Homo sapiens [sequence omitted]

SEQ ID NO: 10137 - protein, 88 aa, Homo sapiens; identical to SEQ ID NO: 10108

SEQ ID NO: 10138 - protein, 93 aa, Homo sapiens
MVIAHTKALDPSQPVTFVTNSTYAADKGALYVDVIRVNSYYSWYRNYGHLELIQLQLAAQFENWCKTSQSHYSERVWSGNACKASPGSTSDVQ

SEQ ID NO: 10139 - protein, 93 aa, Homo sapiens; identical to SEQ ID NO: 10138

SEQ ID NO: 10140 - protein, 90 aa, Homo sapiens
MVIAHTKALDPSQPVTFVTNSTYAADKGALYVDVIRVNSYYSWYRNYGHLELIQLQLAAQFENWCKTSQSHYSERVWSGNACKASPGKRC

SEQ ID NO: 10141 - protein, 93 aa, Homo sapiens; identical to SEQ ID NO: 10138

SEQ ID NO: 10142 - protein, 93 aa, Homo sapiens; identical to SEQ ID NO: 10138

SEQ ID NO: 10143 - protein, 93 aa, Homo sapiens; identical to SEQ ID NO: 10138

SEQ ID NO: 10144 - protein, 93 aa, Homo sapiens; identical to SEQ ID NO: 10138

SEQ ID NO: 10145 - protein, 93 aa, Homo sapiens; identical to SEQ ID NO: 10138

SEQ ID NO: 10146 - protein, 93 aa, Homo sapiens; identical to SEQ ID NO: 10138

SEQ ID NO: 10147 - protein, 93 aa, Homo sapiens; identical to SEQ ID NO: 10138

SEQ ID NO: 10148 - protein, 93 aa, Homo sapiens; identical to SEQ ID NO: 10138

SEQ ID NO: 10149 - protein, 268 aa, Homo sapiens
MNGGVQTWTQPRLCYLVKEGGSHGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEEDHKPKLCRLAKGTEGRSC

SEQ ID NO: 10150 - protein, 213 aa, Homo sapiens
MIRKGGDQTSLLVVDKETDNMYRLAHFSPFLYYQSQELPNGSVKEAPAPTPTSLEVSSPPDTTEEEDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESKHDSHMAKERAHSTASHSSSNSEDTEM

SEQ ID NO: 10151 - protein, 375 aa, Homo sapiens [sequence omitted]

SEQ ID NO: 10152 - protein, 109 aa, Homo sapiens
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRYLVEKIS

SEQ ID NO: 10153 - protein, 366 aa, Homo sapiens
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKSKKKEKEMADQTCIEEFVIHALAFCESLYDPYRNWRHRISGRILSTVEKSRQKYKPASLTVEFVPFFYQCFQESEHLKESLKCCLLHLFGAIVAGGQRNALQAISPATMEVLMRVLADCDSWEDGDPEEVGRKAELTLKCLTEVVHILLSSNSDQRQVETSTILENYFKLLNSDHSALPNQRRSRQWENRFIALQIKMLNTITAMLDCTDRPVLQAIFLNSNCFEHLIRLLQNCK

SEQ ID NO: 10154 - protein, 315 aa, Homo sapiens
MPPGISLLPDNILQVLRIQLLQCVQKMADGLEEQQQALSILLVKFFIILCRNLSNVEEIGTCSYINYVITMTTLYIQQLKSKKKEKEMADQTCIEEFVIHALAFCESLYDPYRNWRHRISGRILSTVEKSRQKYKPASLTVEFVPFFYQCFQESEHLKESLKCCLLHLFGAIVAGGQRNALQAISPATMEVLMRVLADCDSWEDGDPEEVGRKAELTLKCLTEVVHILLSSNSDQRQVETSTILENYFKLLNSDHSALPNQRRSRQWENRFIALQIKMLNTITAMLDCTDRPVLQAIFLNSNCFEHLIRLLQNCK

SEQ ID NO: 10155 - protein, 200 aa, Homo sapiens
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKSKKKEKEMADQTCIEEFVIHALAFCESLYDPYRNWRHRISGSQIPEGFLRHISIRVSSGKNPATPTPEG

SEQ ID NO: 10156 - protein, 375 aa, Homo sapiens [sequence omitted]

SEQ ID NO: 10157 - protein, 109 aa, Homo sapiens; identical to SEQ ID NO: 10152

SEQ ID NO: 10158 - protein, 366 aa, Homo sapiens; identical to SEQ ID NO: 10153

SEQ ID NO: 10159 - protein, 315 aa, Homo sapiens; identical to SEQ ID NO: 10154

SEQ ID NO: 10160 - protein, 200 aa, Homo sapiens; identical to SEQ ID NO: 10155

SEQ ID NO: 10161 - protein, 1240 aa, Homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 10162 - protein, 475 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 10163 - protein, 683 aa, Homo sapiens
MAAAVAAPLAAGGEEAAATTSVPGSPGLPGRRSAERALEEAVATGTLNLSNRRLKHFPRGAARSYDLSDITQADLSRNRFPEVPEAACQLVSLEGLSLYHNCLRCLNPALGNLTALTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPCPAEDLFPGHRYDGGLDSGFHSVDSGSKRWSGNESTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 10164 - protein, 1394 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 10165 - protein, 367 aa, Homo sapiens
MASELCKTISVARLEKHKNLFLNYRNLHHFPLELLKDEGLQYLERLYMKRNSLTSLPENLAQKLPNLVELYLHSNNIVVVPEAIGSLVKLQCLDLSDNALEIVCPEIGRLRALRHLRLANNQLQFLPPEVGDLKELQTLDISTNRLLTLPERLHMCLSLQYLTVDRNRLWYVPRHLCQLPSLNELSMAGNRLAFLPLDLGRSRELQYVYVDNNIHLKGLPSYLYNKVIGCSGCGAPIQVSEVKLLSFSSGQRTVFLPAEVKAIGTEHDHVLPLQELAMRGLYHTYHSLLKDLNFLSPISLPRSLLELLHCPLGHCHRCSEPMFTIVYPKLFPLRETPMAGLHQWKTTVSFVAYCCSTQCLQTFDLLS

SEQ ID NO: 10166 - protein, 754 aa, Homo sapiens
MAEQWELDEEGIRRLGALTLEQPELVESLSLQGSYAGKIHSISDAFRNFKNLRSLDLSRNLITSLKGIQYLCSLQDLNLYYNNIPSLVEVSRLQPLPFLKELDLRLNPVVRKDTDYRLFAVYTLQTLEKLDDRTVREGERKAAKLHFSQLGNSENFLLEVEKSSREKTMKNCVTGESSASKVSANVDSRIEMDSNKGLFIPFPNREIKDSLSTSATQGNGTRDQKLDTFPLGTQTQEVARREMPSDNHQEDEFRHYSPRQSTVRSPEKMTREGYQVSFLDNKSSGSSPEKELIPKPDTFHLTHDASLSKCLDVGDSSQIHPYQLPSDVGLENYDSCYSQTLSLHGSLGKRPQRSKNYQEYSIKPSNDIKTTASHSCGDLLTSLSNPDSSTGRLLKLSSDLYATTHFNSDPAVLVNVEQQLSTSLDDLTPAHGSVPNNAVLGNRTTPLRTLLLSPGTSEHRKIFTKRSLSPSKRGFKWKDNILANLNLKHGFQDATGSEPLSSDLGSLHGLAGNHSPPISARTPHVATVLRQLLELVDKHWNGSGSLLLNKKFLGPARDLLLSLVVPAPSQPRCCSHPEDTMKAFCRRELELKEAAQLVPNDMESLKQKLVRVLEENLILSEKIQQLEEGAAISIVSGQQSHTYDDLLHKNQQLTMQVACLNQELAQLKKLEKTVAILHESQRSLVVTNEYLLQQLNKEPKGYSGKALLPPEKGHHLGRSSPFGKSTLSSSSPVAHETGQYLIQSVLDAAPEPGL

SEQ ID NO: 10167 - protein, 812 aa, Homo sapiens
MAAPEAWRARSCWFCEVAAATTMEATSREAAPAKSSASGPNAPPALFELCGRAVSAHMGVLESGVWALPGPILQSILPLLNIYYLERIEETALKKGLSTQAIWRRLWDELMKTRPSSLESVTCWRAKFMEAFFSHVLRGTIDVSSDRRLCDQRFSPLLHSSRHVRQLTICNMLQGATELVAEPNRRVLETLASSLHTLKFRHLLFSDVAAQQSLRQLLHQLIHHGAVSQVSLYSWPVPESALFILILTMSAGFWQPGPGGPPCRLCGEASRGRAPSRDEGSLLLGSRRPRRDAAERCAAALMASRRKSEAKQMPRAAPATRVTRRSTQESLTAGGTDLKRELHPPATSHEAPGTKRSPSAPAATSSASSSTSSYKRAPASSAPQPKPLKRFKRAAGKKGARTRQGPGAESEDLYDFVFIVAGEKEDGEEMEIGEVACGALDGSDPSCLGLPALEASQRFRSISTLELFTVPLSTEAALTLCHLLSSWVSLESLTLSYNGLGSNIFRLLDSLRALSGQAGCRLRALHLSDLFSPLPILELTRAIVRALPLLRVLSIRVDHPSQRDNPGVPGNAGPPSHIIGDEEIPENCLEQLEMGFPRGAQPAPLLCSVLKASGSLQQLSLDSATFASPQDFGLVLQTLKEYNLALKRLSFHDMNLADCQSEVLFLLQNLTLQEITFSFCRLFEKRPAQFLPEMVAAMKGNSTLKGLRLPGNRLGNAGLLALADVFSEDSSSSLCQLDISSNCIKPDGLLEFAKRLERWGRGAFGHLRLFQNWLDQDAVTAREAIRRLRATCHVVSDSWDSSQAFADYVSTM

SEQ ID NO: 10168 - protein, 725 aa, Homo sapiens
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDLRVLNLMGNPVIRQIPNYRRTVTVRLKHLTYLDDRPVFPKDRACAEAWARGGYAAEKEERQQWESRERKKITDSIEALAMIKQRAEERKRQRESQERGEMTSSDDGENVPASAEGKEEPPGDRETRQKMELFVKESFEAKDELCPERPSGEEPPVEAKREDGGPEPEGTLPAETLLLSSPVEVKGEDGDGEPEGTLPAEAPPPPPPVEVKGEDGDQEPEGTLPAETLLLSPPVKVKGEDGDREPEGTLPAEAPPPLPLGAAREEPTPQAVATEGVFVTELDGTRTEDLETIRLETKETCCIDDLPDLEDDDETGKSLEDQNMCFPKIEVISSLSDDSDPELDYTSLPVLENLPTDTLSNIFAVSKDTSKAARVPFTDIFKKEAKRDSEIRKQDTKSPRPLIQELSDEDPSGQPLMPPTCQRDAAPLTSTGDRDSDFLAASSPVPTESAATPPETCVGVAQPSQALPTWDLTAFPAPKAS

SEQ ID NO: 10169 - protein, 466 aa, Homo sapiens
MGWITEDLIRRNAEHNDCVIFSLEELSLHQQEIERLEHIDKWCRDLKILYLQNNLIGKIENVSKLKKLEYLNLALNNIEKIENLEGCEELAKLDLTVNFIGELSSIKNLQHNIHLKELFLMGNPCASFDHYREFVVATLPQLKWLDGKEIEPSERIKALQDYSVIEPQIREQEKDHCLKRAKLKEEAQRKHQEEDKNEDKRSNAGFDGRWYTDINATLSSLESKDHLQAPDTEEHNTKKLDNSEDDLEFWNKPCLFTPESRLETLRHMEKQRKKQEKLSEKKKKVKPPRTLITEDGKALNVNEPKIDFSLKDNEKQIILDLAVYRYMDTSLIDVDVQPTYVRVMIKGKPFQLVLPAEVKPDSSSAKRSQTTGHLVICMPKVGEVITGGQRAFKSMKTTSDRSREQTNTRSKHMEKLEVDPSKHSFPDVTNIVQEKKHTPRRRPEPKIIPSEEDPTFEDNPEVPPLI

SEQ ID NO: 10170 - protein, 1537 aa, Homo sapiens
MTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 10171 - protein, 858 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFANGI

SEQ ID NO: 10172 - protein, 239 aa, Homo sapiens
MAPYGPLAASSLLSQQYAASLGLEKLVSPPASAAASSPSSSPSPQPVSELDLSSEPQQLTAKGCLFCFRSLFTYTQSHIVLFRVPTGPGTLEREEMERGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKRPILLLVFWT

SEQ ID NO: 10173 - protein, 732 aa, Homo sapiens
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 10174 - protein, 732 aa, Homo sapiens; identical to SEQ ID NO: 10173

SEQ ID NO: 10175 - protein, 211 aa, Homo sapiens
MTTLTRQDLNFGQVVAAVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 10176 - protein, 1156 aa, Homo sapiens
MGDTAPPQAPAGGLGGASGAGLLGGGSVTPRVHSAIVERLRARIAVCRQHHLSCEGRYERGRAESSDRERESTLQLLSLVQHGQGARKAGKHTKATATAATTTAPPPPPAAPPAASQAAATAAPPPPPDYHHHHQQHLLNSSNNGGSGGINGEQQPPASTPGDQRNSALIALQGSLKRKQVVNLSPANSKRPNGFVDNSFLDIKRIRVGENLSAGQGGLQINNGQSQIMSGTLPMSQAPLRKTNTLPSHTHSPGNGLFNMGLKEVKKEPGETLSCSKHMDGQMTQENIFPNRYGDDPGEQLMDPELQELFNELTNISVPPMSDLELENMINATIKQDDPFNIDLGQQSQRSTPRPSLPMEKIVIKSEYSPGLTQGPSGSPQLRPPSAGPAFSMANSALSTSSPIPSVPQSQAQPQTGSGASRALPSWQEVSHAQQLKQIAANRQQHARMQQHQQQHQPTNWSALPSSAGPSPGPFGQEKIPSPSFGQQTFSPQSSPMPGVAGGSGQSKVMANYMYKAGPSAQGGHLDVLMQQKPQDLSRSFINNPHPAMEPRQGNTKPLFHFNSDQANQQMPSVLPSQNKPSLLHYTQQQQQQQQQQQQQQQQQQQQQQQQQQQQQQQQQQSSISAQQQQQQQSSISAQQQQQQQQQQQQQQQQQQQQQQQQQQQPSSQPAQSLPSQPLLRSPLPLQQKLLLQQMQNQPIAGMGYQVSQQQRQDQHSVVGQNTGPSPSPNPCSNPNTGSGYMNSQQSLLNQQLMGKKQTLQRQIMEQKQQLLLQQQMLADAEKIAPQDQINRHLSRPPPDYKDQRRNVGNMQPTAQYSGGSSTISLNSNQALANPVSTHTILTPNSSLLSTSHGTRMPSLSTAVQNMGMYGNLPCNQPNTYSVTSGMNQLTQQRNPKQLLANQNNPMMPRPPTLGPSNNNNVATFGAGSVGNSQQLRPNLTHSMASMPPQRTSNVMITSNTTAPNWASQEGTSKQQEALTSAGVRFPTGTPAAYTPNQSLQQAVGSQQFSQRAVAPPNQLTPAVQMRPMNQMSQTLNGQTMGPLRGLNLRPNQLSTQILPNLNQSGTGLNQSRTGINQPPSLTPSNFPSPNQSSRAFQGTDHSSDLAFDFLSQQNDNMGPALNSDADFIDSLLKTEPGNDDWMKDINLDEILGNNS

SEQ ID NO: 10177 - protein, 1133 aa, Homo sapiens
MGDFAAPAAAANGSSICINSSLNSSLGGAGIGVNNTPNSTPAAPSSNHPAAGGCGGSGGPGGGSAAVPKHSTVVERLRQRIEGCRRHHVNCENRYQQAQVEQLELERRDTVSLYQRTLEQRAKKSGAGTGKQQHPSKPQQDAEAASAEQRNHTLIMLQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQHPVGLPRTTGPMQSSVPPGSGGMVSGASPAGPGFLGSQPQAAIMKQMLIDQRAQLIEQQKQQFLREQRQQQQQQQQILAEQQLQQSHLPRQHLQPQRNPYPVQQVNQFQGSPQDIAAVRSQAALQSMRTSRLMAQNAGMMGIGPSQNPGTMATAAAQSEMGLAPYSTTPTSQPGMYNMSTGMTQMLQHPNQSGMSITHNQAQGPRQPASGQGVGMVSGFGQSMLVNSAITQQHPQMKGPVGQALPRPQAPPRLQSLMGTVQQGAQSWQQRSLQGMPGRTSGELGPFNNGASYPLQAGQPRLTKQHFPQGLSQSVVDANTGTVRTLNPAAMGRQMMPSLPGQQGTSQARPMVMSGLSQGVPGMPAFSQPPAQQQIPSGSFAPSSQSQAYERNAPQDVSYNYSGDGAGGSFPGLPDGADLVDSIIKGGPGDEWMQELDELFGNP

SEQ ID NO: 10178 - protein, 1040 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 10179 - protein, 522 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 10180 - protein, 323 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGACD

SEQ ID NO: 10181 - protein, 475 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 10182 - protein, 330 aa, Homo sapiens
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 10183 - protein, 330 aa, Homo sapiens; identical to SEQ ID NO: 10182

SEQ ID NO: 10184 - protein, 486 aa, Homo sapiens
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 10185 - protein, 346 aa, Homo sapiens
MLKSRLRMFLNELKLLVLTGGGRPRAEPQPRGGRGGGCGWAPFAGCSTRDGDGDEEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 10186 - protein, 332 aa, Homo sapiens
MGAQFSKTAAKGEAAAERPGEAAVASSPSKANGQENGHVKVNGDASPAAAESGAKEELQANGSAPAADKEEPAAAGSGAASPSSAEKGEPAAAAAPEAGASPVEKEAPAEGEAAEPGSATAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 10187 - protein, 173 aa, Homo sapiens
MLPPPPRQPPPQARAARGAVRLQRPFLRSPLGVLRLLQLLAGAAFWITIATSKYQGPVHFALFVSVLFWLLTLGLYFLTLLGKHELVPVLGSRWLMVNVAHDVLAAALYGAATGIMSDQMQRHSYCNLKDYPLPCAYHAFLAAAVCGGVCHGLYLLSALYGCGRRCQGKQEVA

SEQ ID NO: 10188 - protein, 367 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIVPMMHSATSATVSAATTPATSVPFAATATANQIILK

SEQ ID NO: 10189 - protein, 361 aa, Homo sapiens
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTDNSEIISRNGMECQESALRITKHCYCTYYPVSSSIELPQTAC

SEQ ID NO: 10190 - protein, 1052 aa, Homo sapiens
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 10191 - protein, 746 aa, Homo sapiens
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHGGPGLLCGTNQQGQEQAEAEEAQGEAPAAHAAGSPAKDPFGVTGSLADREGQREPSRTALVGEPSCGGGWFKRDPVSSCRFVRVCSTWACPPVMGRGSWYIEKIPVDPVRRDLVALPPVRLPAGSCAHQRLGRTGKAVWGLLTAGEGCTFQTNDTTLTKLKDAC

SEQ ID NO: 10192 - protein, 307 aa, Homo sapiens
MGEQNHSPGKELQHRTRAEAPGKKSWHSQAYALGAVSNFMSTFLTFPIYKVVFRQQIHAMAVSEAVRQLWHEGPQYFYRGIYPPLLSKTLQGTLLFGTYDSLLCFLSPVGPHTLGHRWAAGLMSGVVEAVALSPFERVQNVLQDGRKQARFPSTFCILKEFNSYGLWGRLSLGYYRGFWPVLARNSLGSALYFSFKDPIQDGLAEQGLPHWVPALVSGSVNGTITCLVLYPLIVLVANMQSHIGWQNMPSLWASAQDVWNTRGRKLLLIYRGGSLVILRSSVTWGLTTAIHDFLQRKSHSRKELKTD

SEQ ID NO: 10193 - protein, 734 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 10194 - protein, 178 aa, Homo sapiens
MAAPLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLEQASANIPAPLKPT

SEQ ID NO: 10195 - protein, 473 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 10196 - protein, 525 aa, Homo sapiens
MRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 10197 - protein, 255 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKVLKPGKSVLFRDYGLYDHAMLRFKASSKLGENFYVRQDGTRSYFFTDDFLAQLFMDTGYEEVVNEYVFRETVNKKEGL

SEQ ID NO: 10198 - protein, 173 aa, Homo sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 10199 - protein, 387 aa, Homo sapiens
MPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 10200 - protein, 2855 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 10201 - protein, 2855 aa, Homo sapiens; identical to SEQ ID NO: 10200

SEQ ID NO: 10202 - protein, 627 aa, Homo sapiens
MRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 10203 - protein, 1563 aa, Homo sapiens
MASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 10204 - protein, 2855 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKSLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 10205 - protein, 2855 aa, Homo sapiens; identical to SEQ ID NO: 10204

SEQ ID NO: 10206 - protein, 627 aa, Homo sapiens; identical to SEQ ID NO: 10202

SEQ ID NO: 10207 - protein, 1563 aa, Homo sapiens; identical to SEQ ID NO: 10203

SEQ ID NO: 10208 - protein, 478 aa, Homo sapiens
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSSYLRLGEFKNGNFEMSGVNQKIPFDIHCMRIYVTKTQKEWLIIRSISIWTS

SEQ ID NO: 10209 - protein, 213 aa, Homo sapiens
MEDLLDLDEELRYSLATSRAKMGRRAQQESAQAENHLNGKNSSLTLTGETSSAKLPRCRQGGWAGDSVKASNGTQTGKQQLDLNACYHKTHHRNLGLASLEEADIPIIPDLEEVQEEDFVLQVAAPPSIQIKRVMTYRDLDNDLMKYSAIQTLDGEIDLKLLTKVLAPEHEVREDDVGWDWDHLFTEVSSEVLTEWDPLQTEKEDPAGQARHT

SEQ ID NO: 10210 - protein, 91 aa, Homo sapiens
MRKLRLRASNPGPSGAPGTRRHFSTSGGGHHCARRWLRRVRRSRSQTPSCQNLDPNPPIARFPLPLERISEVPRRACLHGRDASSIKCCFP

SEQ ID NO: 10211 - protein, 318 aa, Homo sapiens
MGNGVKEGPVRLHEDAEAVLSSSVSSKRDHRQVLSSLLPGALAGALAKTAVAPLDRTKIIFQVSSKRFSAKEAFRVLYYTYLNEGFLSLWRGNSATMVRVVPYAAIQFSAHEEYKRILGSYYGFRGEALPPWPRLFAGALAGTTAASLTYPLDLVRARMAVTPKEMYSNIFHVFIRISREEGLKTLYHGFMPTVLGVIPYAGLSFFTYETLKSLHREYSGRRQPYPFERMIFGACAGLIGQSASYPLDVVRRRMQTAGVTGYPRASIARTLRTIVREEGAVRGLYKGLSMNWVKGPIAVGISFTTFDLMQIMLRHLQS

SEQ ID NO: 10212 - protein, 468 aa, Homo sapiens
MPEDGAGDGGEVPALIPDGEPLREEQRPLKQSLGSSLCRESHWKCLLLTLLIHACGAVVAWCRLATVPRLVLGPEAALARGAGGPPPTYPASPCSDGYLYIPLAFVSLLYLLYLAECWHCHVRSCQAPRTDAHTVLALIRRLQQAPPCVWWKATSYHYVRRTRQITRYRNGDAYTTTQVYHERADSRTARGEFDYSAHGVRDVSKELVGLAEHAATRLRFTKCFSFGSAEAEASYLTQRARFFSANEGLDDYLEAREGMHLKDVDFRESLMVFADPRSPPWYARAWVFWLVSAATLSWPLRVVAAYGTAHVHYQVEKLFGASSPPPGAVPSGPPLSRVATVDFTELEWHICSNRQLVPSYSEAVVMGAGSGAYLRGCQRCRRSVSSNSLPPARPSGPRLPFSRSRLSLGAGGRATPGVFRSLSGGPLGRRGEDTEPLESPPCYEDALYFPVLIVHGDSGCQGDGQGAL

SEQ ID NO: 10213 - protein, 243 aa, Homo sapiens
MGIFLVYVGFVFFSVLYVQQGLSSQAKFTEFPRNVTATEGQNVEMSCAFQSGSASVYLEIQWWFLRGPEDLDPGAEGAGAQVKLLPDRDPDSDGTKISTVKVQGNDISHKLQISKVRKKDEGLYECRVTDANYGELQEHKAQAYLKVNANSHARRMQAFEASPMWLQDMKPRKNVSAAIPSSIHGSANQRTHSTSSPQVVAKIPKQSPQSGMETHFEPFILPLTNAPQKGQSYRVDRFMNGDF

SEQ ID NO: 10214 - protein, 297 aa, Homo sapiens
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPVFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 10215 - protein, 198 aa, Homo sapiens
MTATVISKTIITTNPDIPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCTFVLSHRARSGLKISVLSCKLADPTEASRNLSGQKHV

SEQ ID NO: 10216 - protein, 262 aa, Homo sapiens
MALSLGWKAHRNHCGLLLQALRSSGLLLFPCGQCPWRGAGSFLDPEIKAFLEENTEVTSSGSLTPEIQLRLLTPRCKFWWERADLWPHSDPYWAIYWPGGQALSRYLLDNPDVVRGKSVLDLGSGCGATAIAAKMSGASRILANDIDPIAGMAITLNCELNRLNPFPILIQNILNLEQDKWDLVVLGDMFYDEDLADSLHQWLKKCFWTYRTRVLIGDPGRPQFSGHSIQHHLHKVVEYSLLESTRQENSGLTTSTVWGFQP

SEQ ID NO: 10217 - protein, 83 aa, Homo sapiens
MGLMTAPHTHQRGLQIVRDERKISGPGDSIIKRKRMRKKIADEKNQPNSGSWKADARRPLNDASTLILDFPASRTMSQYISVP

SEQ ID NO: 10218 - protein, 83 aa, Homo sapiens; identical to SEQ ID NO: 10217

SEQ ID NO: 10219 - protein, 916 aa, Homo sapiens
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 10220 - protein, 152 aa, Homo sapiens
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 10221 - protein, 285 aa, Homo sapiens
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 10222 - protein, 442 aa, Homo sapiens
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAALVEEVYFAQKERDEAVMSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 10223 - protein, 735 aa, Homo sapiens
MAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALGFSDVDHTYAQRTQLFDTLVNFFPDSMTPPKGNLVDLITL

SEQ ID NO: 10224 - protein, 568 aa, Homo sapiens
MASSCSVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 10225 - protein, 607 aa, Homo sapiens
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 10226 - protein, 760 aa, Homo sapiens
MIITEDSLPSLEAILNYSIFNRENDLLAQFDAIPGKKGTRVLIWNIRRNKNGKSELDFDTDQYDILVSDFDTEEKMTGGVTSELPETEYSLRAFCGILYMKPRMKIFLRQKKVTTQMIAKSLANVEYDTHKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELIDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQVSYRTPEGDDLERALAKLTRLRIHVSYLLTSVLPHLELREIGYDSEQVDGILYTVLEANHILD

SEQ ID NO: 10227 - protein, 585 aa, Homo sapiens
MPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 10228 - protein, 326 aa, Homo sapiens
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 10229 - protein, 355 aa, Homo sapiens
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 10230 - protein, 416 aa, Homo sapiens
MSASEGMKFKFHSGEKVLCFEPDPTKARVLYDAKIVDVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKSRFILGCPRPGRASVYFVFSQCQAWC

SEQ ID NO: 10231 - protein, 521 aa, Homo sapiens
MSASEGMKFKFHSGEKVLCFEPDPTKARVLYDAKIVVVIVGKDEKGRKIPEYLIHFNGWNRSWDRWAAEDHVLRDTDENRRLQRKLARKAVARLRSTGRKKKRCRLPGVDSVLKGLPTEEKDENDENSLSSSSDCSENKDEEISEESDIEEKTEVKEEPELQTRREMEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRRTNEINEVLSWKLVPDNYPPGDQPPPPSYIYGAQHLLRLFVKLPEILGKMSFSEKNLKALLKHFDLFLRFLAEYHDDFFPESAYVAACEAHYSTKNPRAIY

SEQ ID NO: 10232 - protein, 372 aa, Homo sapiens
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 10233 - protein, 417 aa, Homo sapiens
MALSAQQIPRWFNSVKLRSLINAAQLTKRFTRPARTLLHGFSAQPQISSDNCFLQWGFKTYRTSSLWNSSQSTSSSSQENNSAQSSLLPSMNEQSQKTQNISSFDSELFLEELDELPPLSPMQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQVFNTRLFKVKERHLFLTYLGRAQYDPAKPNYISLDKLVSIPDEIFCEEIAKASVQDFEKFLKTL

SEQ ID NO: 10234 - protein, 698 aa, Homo sapiens
MRRFLLLYATQQGQAKAIAEEMCEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASLRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 10235 - protein, 725 aa, Homo sapiens
MGAASVRAGARLVEVALCSFTVTCLEVMRRFLLLYATQQGQAKAIAEEMCEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASLRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 10236 - protein, 662 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 10237 - protein, 4640 aa, Homo sapiens
MPVPDGSVAAAGLGLGLPAADSPGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEVLQSEPPEVLESLFQLLLEITVRSTGMNDSTGQSLTALSCACLFSLVASWGETGRTLQAISAILTNNGSHACQTIQVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAQLKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 10238 - protein, 1938 aa, Homo sapiens
MSSDAEMAIFGEAAPYLRKPEKERIEAQNRPFDSKKACFVADNKEMYVKGMIQTRENDKVIVKTLDDRMLTLNNDQVFPMNPPKFDKIEDMAMMTHLHEPAVLYNLKERYAAWMIYTYSGLFCVTVNPYKWLPVYKPEVVAAYRGKKRQEAPPHIFSISDNAYQFMLTDRDNQSILITGESGAGKTVNTKRVIQYFATIAVTGDKKKETQPGKMQGTLEDQIIQANPLLEAFGNAKTVRNDNSSRFGKFIRIHFGATGKLASADIETYLLEKSRVTFQLSSERSYHIFYQIMSNKKPELIDLLLISTNPFDFPFVSQGEVTVASIDDSEELLATDNAIDILGFSSEEKVGIYKLTGAVMHYGNMKFKQKQREEQAEPDGTEVADKAGYLMGLNSAEMLKGLCCPRVKVGNEYVTKGQNVQQVTNSVGALAKAVYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNIAGWLDKNKDPLNETVVGLYQKSSLKLLSFLFSNYAGAETGDSGGSKKGGKKKGSSFQTVSAVFRENLNKLMTNLRSTHPHFVRCLIPNETKTPGVMDHYLVMHQLRCNGVLEGIRICRKGFPSRILYADFKQRYRILNASAIPEGQFIDSKNASEKLLNSIDVDREQFRFGNTKVFFKAGLLGLLEEMRDEKLVTLMTSTQAVCRGYLMRVEFKKMMERRDSIFCIQYNIRSFMNVKHWPWMNLFFKIKPLLKSAEAEKEMATMKEDFERTKEELARSEARRKELEEKMVSLLQEKNDLQLQVQSETENLMDAEERCEGLIKSKILLEAKVKELTERLEEEEEMNSELVAKKRNLEDKCSSLKRDIDDLELTLTKVEKEKHATENKVKNLSEEMTALEENISKLTKEKKSLQEAHQQTLDDLQVEEDKVNGLIKINAKLEQQTDDLEGSLEQEKKLRADLERAKRKLEGDLKMSQESIMDLENEKQQIEEKLKKKEFELSQLQARIDDEQVHSLQFQKKIKELQARIEELEEEIEAEHTLRAKIEKQRSDLARELEEISERLEEASGATSAQIEMNKKREAEFQKMRRDLEEATLQHEATAATLRKKQADSVAELGEQIDNLQRVKQKLEKEKSELKMEIDDMASNIEALSKSKSNIERTCRTVEDQFSEIKAKDEQQTQLIHDLNMQKARLQTQNGELSHRVEEKESLISQLTKSKQALTQQLEELKRQMEEETKAKNAMAHALQSSRHDCDLLREQYEEEQEAKAELQRALSKANSEVAQWKTKYETDAIQRTEELEEAKKKLAQRLQEAEEKTETANSKCASLEKTKQRLQGEVEDLMRDLERSHTACATLDKKQRNFDKVLAEWKQKLDESQAELEAAQKESRSLSTELFKMRNAYEEVVDQLETLRRENKNLQEEISDLTEQIAETGKNLQEAEKTKKLVEQEKSDLQVALEEVEGSLEHEESKILRVQLELSQVKSELDRKVIEKDEEIEQLKRNSQRAAEALQSVLDAEIRSRNDALRLKKKMEGDLNEMEIQLGHSNRQMAETQRHLRTVQGQLKDSQLHLDDALRSNEDLKEQLAIVERRNGLLLEELEEMKVALEQTERTRRLSEQELLDASDRVQLLHSQNTSLINTKKKLEADIAQCQAEVENSIQESRNAEEKAKKAITDAAMMAEELKKEQDTSAHLERMKKNLEQTVKDLQHRLDEAEQLALKGGKKQIQKLENRVRELENELDVEQKRGAEALKGAHKYERKVKEMTYQAEEDRKNILRLQDLVDKLQAKVKSYKRQAEEAEEQANTQLSRCRRVQHELEEAAERADIAESQVNKLRAKSRDVGSQKMEE

SEQ ID NO: 10239 - protein, 2073 aa, Homo sapiens
MVKLANPLYTEWILEAIQKIKKQKQRPSEERICHAVSTSHGLDKKTVSEQLELSVQDGSVLKVTNKGLASYKDPDNPGRFSSVKPGTFPKSAKGSRGSCNDLRNVDWNKLLRRAIEGLEEPNGSSLKNIEKYLRSQSDLTSTTNNPAFQQRLRLGAKRAVNNGRLLKDGPQYRVNYGSLDGKGAPQYPSAFPSSLPPVSLLPHEKDQPRADPIPICSFCLGTKESNREKKPEELLSCADCGSSGHPSCLKFCPELTTNVKALRWQCIECKTCSACRVQGRNADNMLFCDSCDRGFHMECCDPPLSRMPKGMWICQVCRPKKKGRKLLHEKAAQIKRRYAKPIGRPKNKLKQRLLSVTSDEGSMNAFTGRGSPGRGQKTKVCTTPSSGHAASGKDSSSRLAVTDPTRPGATTKITTTSTYISASTLKVNKKTKGLIDGLTKFFTPSPDGRRSRGEIIDFSKHYRPRKKVSQKQSCTSHVLATGTTQKLKPPPSSLPPPTPISGQSPSSQKSSTATSSPSPQSSSSQCSVPSLSSLTTNSQLKALFDGLSHTIPLRDSLAKRDTPSYAPPKRMRRKTELSSTAKSKAHFFGKRDIRSRFISHSSSSSWGMARGSIFKAIAHFKRTTFLKKHRMLGRLKYKVTPQMGTPSPGKGSLTDGRIKPDQDDDTEIKINIKQESADVNVIGNKDVVTEEDLDVFKQAQELSWEKIECESGVEDCGRYPSVIEFGKYEIQTWYSSPYPQEYARLPKLYLCEFCLKYMKSKNILLRHSKKCGWFHPPANEIYRRKDLSVFEVDGNMSKIYCQNLCLLAKLFLDHKTLYYDVEPFLFYVLTKNDEKGCHLVGYLSKEKLCQQKYNVSCIMIMPQHQRQGFGRFLIDFSYLLSRREGQAGSPEKPLSDLGRLSYLAYWKSVILEYLYHHHERHISIKAISRATGMCPHDIATTLQHLHMIDKRDGRFVIIRREKLILSHMEKLKTCSRANELDPDSLRWTPILISNAAVSEEEREAEKEAERLMEQASCWEKEEQEILSTRANSRQSPAKVQSKNKYLHSPESRPVTGERGQLLELSKESSEEEEEEEDEEEEEEEEEEEEDEEEEEEEEEEEEEENIQSSPPRLTKPQSVAIKRKRPFVLKKKRGRKRRRINSSVTTETISETTEVLNEPFDNSDEERPMPQLEPTCEIEVEEDGRKPVLRKAFQHQPGKKRQTEEEEGKDNHCFKNADPCRNNMNDDSSNLKEGSKDNPEPLKCKQVWPKGTKRGLSKWRQNKERKTGFKLNLYTPPETPMEPDEQVTVEEQKETSEGKTSPSPIRIEEEVKETGEALLPQEENRREETCAPVSPNTSPGEKPEDDLIKPEEEEEEEEEEEEEEEEEEGEEEEGGGNVEKDPDGAKSQEKEEPEISTEKEDSARLDDHEEEEEEDEEPSHNEDHDADDEDDSHMESAEVEKEELPRESFKEVLENQETFLDLNVQPGHSNPEVLMDCGVDLTASCNSEPKELAGDPEAVPESDEEPPPGEQAQKQDQKNSKEVDTEFKEGNPATMEIDSETVQAVQSLTQESSEQDDTFQDCAETQEACRSLQNYTRADQSPQIATTLDDCQQSDHSSPVSSVHSHPGQSVRSVNSPSVPALENSYAQISPDQSAISVPSLQNMETSPMMDVPSVSDHSQQVVDSGFSDLGSIESTTENYENPSSYDSTMGGSICGNGSSQNSCSYSNLTSSSLTQSSCAVTQQMSNISGSCSMLQQTSISSPPTCSVKSPQGCVVERPPSSSQQLAQCSMAANFTPPMQLAEIPETSNANIGLYERMGQSDFGAGHYPQPSATFSLAKLQQLTNTLIDHSLPYSHSAAVTSYANSASLSTPLSNTGLVQLSQSPHSVPGGPQAQATMTPPPNLTPPPMNLPPPLLQRNMAASNIGISHSQRLQTQIASKGHISMRTKSASLSPAAATHQSQIYGRSQTVAMQGPARTLTMQRGMNMSVNLMPAPAYNVNSVNMNMNTLNAMNGYSMSQPMMNSGYHSNHGYMNQTPQYPMQMQMGMMGTQPYAQQPMQTPPHGNMMYTAPGHHGYMNTGMSKQSLNGSYMRR

SEQ ID NO: 10240 - protein, 1184 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 10241 - protein, 1154 aa, Homo sapiens
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKSSPTPNPPIFSLPLVGLVVISALLWCWWAETSS

SEQ ID NO: 10242 - protein, 506 aa, Homo sapiens
MAEADFKMVSEPVAHGVAEEEMASSTSDSGEESDSSSSSSSTSDSSSSSSTSGSSSGSGSSSSSSGSTSSRSRLYRKKRVPEPSRRARRAPLGTNFVDRLPQAVRNRVQALRNIQDECDKVDTLFLKAIHDLERKYAELNKPLYDRRFQIINAEYEPTEEECEWNSEDEEFSSDEEVQDNTPSEMPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 10243 - protein, 393 aa, Homo sapiens
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNNDENF

SEQ ID NO: 10244 - protein, 1128 aa, Homo sapiens
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 10245 - protein, 1134 aa, Homo sapiens
MSRSVLQPSQQKLAEKLTILNDRGVGMLTRLYNIKKQGQVWKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 10246 - protein, 722 aa, Homo sapiens
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 10247 - protein, 715 aa, Homo sapiens
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 10248 - protein, 816 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 10249 - protein, 525 aa, Homo sapiens
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 10250 - protein, 1068 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 10251 - protein, 1065 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDLFTSNNFDLLQLRPTFWPVPAGRYLRNLE

SEQ ID NO: 10252 - protein, 1045 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDGKFISDMFLK

SEQ ID NO: 10253 - protein, 1075 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 10254 - protein, 2697 aa, Homo sapiens
MNGDMPHVPITTLAGIASLTDLLNQLPLPSPLPATTTKSLLFNARIAEEVNCLLACRDDNLVSQLVHSLNQVSTDHIELKDNLGSDDPEGDIPVLLQAVLARSPNVFREKSMQNRYVQSGMMMSQYKLSQNSMHSSPASSNYQQTTISHSPSSRFVPPQTSSGNRFMPQQNSPVPSPYAPQSPAGYMPYSHPSSYTTHPQMQQASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 10255 - protein, 2804 aa, Homo sapiens
MNGDMPHVPITTLAGIASLTDLLNQLPLPSPLPATTTKSLLFNARIAEEVNCLLACRDDNLVSQLVHSLNQVSTDHIELKDNLGSDDPEGDIPVLLQAVLARSPNVFREKSMQNRYVQSGMMMSQYKLSQNSMHSSPASSNYQQTTISHSPSSRFVPPQTSSGNRFMPQQNSPVPSPYAPQSPAGYMPYSHPSSYTTHPQMQQASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGSLRRSKRNSDSTELAAQMNESVDVMDVIAICCPKYKDRPQIARVVQKTSSGFSVQWMAGSYSGSWTEAKRRDGRKLVPWVDTIKESDIIYKKIALTSANKLTNKVVQTLRSLYAAKDGTSS

SEQ ID NO: 10256 - protein, 1504 aa, Homo sapiens
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPAEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 10257 - protein, 823 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 10258 - protein, 704 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 10259 - protein, 503 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 10260 - protein, 376 aa, Homo sapiens
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 10261 - protein, 340 aa, Homo sapiens
MHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 10262 - protein, 307 aa, Homo sapiens
MTETTKTHVILLACGSFNPITKGHIQMFERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 10263 - protein, 302 aa, Homo sapiens
MEIQELEEIQACQGLWEVFVTLSERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 10264 - protein, 264 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 10265 - protein, 217 aa, Homo sapiens
MSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 10266 - protein, 217 aa, Homo sapiens; identical to SEQ ID NO: 10265

SEQ ID NO: 10267 - protein, 1267 aa, Homo sapiens
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 10268 - protein, 1222 aa, Homo sapiens
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 10269 - protein, 1222 aa, Homo sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 10270 - protein, 598 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 10271 - protein, 598 aa, Homo sapiens; identical to SEQ ID NO: 10270

SEQ ID NO: 10272 - protein, 325 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKVPRSPRWGLLLEMERGWPHPIGTCGLPLGSPPS

SEQ ID NO: 10273 - protein, 1158 aa, Homo sapiens
MTHGEELGSDVHQDSIVLTYLEGLLMHQAAGGSGTAVDKKSAGHNEEDQNFNISGSAFPTCQSNGPVLNTHTYQGSGMLHLKKARLLQSSEDWNAAKRKRLSDSIMNLNVKKEALLAGMVDSVPKGKQDSTLLASLLQSFSSRLQTVALSQQIRQSLKEQGYALSHDSLKVEKDLRCYGVASSHLKTLLKKSKVKDQKPDTNLPDVTKNLIRDRFAESPHHVGQSGTKVMSEPLSCAARLQAVASMVEKRASPATSPKPSVACSQLALLLSSEAHLQQYSREHALKTQNANQAASERLAAMARLQENGQKDVGSYQLPKGMSSHLNGQARTSSSKLMASKSSATVFQNPMGIIPSSPKNAGYKNSLERNNIKQAANNSLLLHLLKSQTIPKPMNGHSHSERGSIFEESSTPTTIDEYSDNNPSFTDDSSGDESSYSNCVPIDLSCKHRTEKSESDQPVSLDNFTQSLLNTWDPKVPDVDIKEDQDTSKNSKLNSHQKVTLLQLLLGHKNEENVEKNTSPQGVHNDVSKFNTQNYARTSVIESPSTNRTTPVSTPPLLTSSKAGSPINLSQHSLVIKWNSPPYVCSTQSEKLTNTASNHSMDLTKSKDPPGEKPAQNEGAQNSATFSASKLLQNLAQCGMQSSMSVEEQRPSKQLLTGNTDKPIGMIDRLNSPLLSNKTNAVEENKAFSSQPTGPEPGLSGSEIENLLERRTVLQLLLGNPNKGKSEKKEKTPLRDESTQEHSERALSEQILMVKIKSEPCDDLQIPNTNVHLSHDAKSAPFLGMAPAVQRSAPALPVSEDFKSEPVSPQDFSFSKNGLLSRLLRQNQDSYLADDSDRSHRNNEMALLESKNLCMVPKKRKLYTEPLENPFKKMKNNIVDAANNHSAPEVLYGSLLNQEELKFSRNDLEFKYPAGHGSASESEHRSWARESKSFNVLKQLLLSENCVRDLSPHRSNSVADSKKKGHKNNVTNSKPEFSISSLNGLMYSSTQPSSCMDNRTFSYPGVVKTPVSPTFPEHLGCAGSRPESGLLNGCSMPSEKGPIKWVITDAEKNEYEKDSPRLTKTNPILYYMLQKGGNSVTSRETQDKDIWREASSAESVSQVTAKEELLPTAETKASFFNLRSPYNSHMGNNASRPHSANGEVYGLLGSVLTIKKESE

SEQ ID NO: 10274 - protein, 281 aa, Homo sapiens
MLFIFPLSLPWRPSCWKESCSTGQRQAGRSREDSVTPPPSSPWPTPPAGAMSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVDAESPEFCLGLQTLLSLKCCIDLEHGVLRLKAPFSELPFLPLYQEPGQ

SEQ ID NO: 10275 - protein, 1327 aa, Homo sapiens
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSPPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTRQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 10276 - protein, 257 aa, Homo sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 10277 - protein, 822 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 10278 - protein, 838 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 10279 - protein, 612 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTWVFSNIDNHGILNLKDNRDHLVPSTHYIYEEPEVQSGEVSYPRSHGFREIMLNPISLPGHSKPLNHGIYVEDVNVYFSKGRHGF

SEQ ID NO: 10280 - protein, 839 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 10281 - protein, 825 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 10282 - protein, 350 aa, Homo sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 10283 - protein, 300 aa, Homo sapiens
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 10284 - protein, 350 aa, Homo sapiens; identical to SEQ ID NO: 10282

SEQ ID NO: 10285 - protein, 1332 aa, Homo sapiens
MSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 10286 - protein, 1391 aa, Homo sapiens
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 10287 - protein, 2012 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 10288 - protein, 326 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRIWNLEGVQTAHFVLHSPGMSVCWHPEETFKLMVAEKNGTIRFYDLLAQQAILSLESEQVPLMSAHWCLKNTFKVGAVAGNDWLIWDITRSSYPQNKRPVHMDRACLFRWSTISENLFATTGYPGKMASQFQIHHLGHPQPILMGSVAVGSGLSWHRTLPLCVIGGDHKLLFWVTEV

SEQ ID NO: 10289 - protein, 468 aa, Homo sapiens
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 10290 - protein, 440 aa, Homo sapiens
MASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 10291 - protein, 226 aa, Homo sapiens
MNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 10292 - protein, 440 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 10293 - protein, 487 aa, Homo sapiens
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQNSLSSEQQKYAIRGVPSLLEVAGFSYFYGAFLVGPQFSMNHYMKLVQGELIDIPGKIPNSIIPALKRLSLGLFYLVGYTLLSPHITEDYLLTEDYDNHPFWFRCMYMLIWGKFVLYKYVTCWLVTEGVCILTGLGFNGFEEKGKAKWDACANMKVWLFETNPRFTGTIASFNINTNAWVARYIFKRLKFLGNKELSQGLSLLFLALWHGLHSGYLVCFQMEFLIVIVERQAARLIQESPTLSKLAAITVLQPFYYLVQQTIHWLFMGYSMTAFCLFTWDKWLKVYKSIYFLGHIFFLSLLFILPYIHKAMVPRKEKLKKME

SEQ ID NO: 10294 - protein, 273 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 10295 - protein, 1139 aa, Homo sapiens
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 10296 - protein, 815 aa, Homo sapiens
MFRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 10297 - protein, 128 aa, Homo sapiens
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 10298 - protein, 312 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 10299 - protein, 394 aa, Homo sapiens
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENPTSGETLEENEAGD

SEQ ID NO: 10300 - protein, 531 aa, Homo sapiens
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 10301 - protein, 524 aa, Homo sapiens
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 10302 - protein, 379 aa, Homo sapiens
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 10303 - protein, 413 aa, Homo sapiens
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 10304 - protein, 345 aa, Homo sapiens
MARPQRTPARSPDSIVEVKSKFDAEFRRFALPRASVSGFQEFSRLLRAVHQIPGLDVLLGYTDAHGDLLPLTNDDSLHRALASGPPPLRLLVQKREADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 10305 - protein, 346 aa, Homo sapiens
MARPQRTPARSPDSIVEVKSKFDAEFRRFALPRASVSGFQEFSRLLRAVHQIPGLDVLLGYTDAHGDLLPLTNDDSLHRALASGPPPLRLLVQKRAEADSSGLAFASNSLQRRKKGLLLRPVAPLRTRPPLLISLPQDFRQVSSVIDVDLLPETHRRVRLHKHGSDRPLGFYIRDGMSVRVAPQGLERVPGIFISRLVRGGLAESTGLLAVSDEILEVNGIEVAGKTLDQVTDMMVANSHNLIVTVKPANQRNNVVRGASGRLTGPPSAGPGPAEPDSDDDSSDLVIENRQPPSSNGLSQGPPCWDLHPGCRHPGTRSSLPSLDDQEQASSGWGSRIRGDGSGFSL

SEQ ID NO: 10306 - protein, 422 aa, Homo sapiens [sequence omitted]

SEQ ID NO: 10307 - protein, 436 aa, Homo sapiens
MQNSHSGVNQLGGVFVNGRPLPDSTRQKIVELAHSGARPCDISRILQTHADAKVQVLDNQNVSNGCVSKILGRYYETGSIRPRAIGGSKPRVATPEVVSKIAQYKRECPSIFAWEIRDRLLSEGVCTNDNIPSVSSINRVLRNLASEKQQMGADGMYDKLRMLNGQTGSWGTRPGWYPGTSVPGQPTQDGCQQQEGGGENTNSISSNGEDSDEAQMRLQLKRKLQRNRTSFTQEQIEALEKEFERTHYPDVFARERLAAKIDLPEARIQVWFSNRRAKWRREEKLRNQRRQASNTPSHIPISSSFSTSVYQPIPQPTTPVSSFTSGSMLGRTDTALTNTYSALPPMPSFTMANNLPMQPPVPSQTSSYSCMLPTSPSVNGRSYDTYTPPHMQTHMNSQPMGTSGTTSTGLISPGVSVPVQVPGSEPDMSQYWPRLQ

SEQ ID NO: 10308 - protein, 950 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10309 - protein, 686 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10310 - protein, 948 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10311 - protein, 685 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10312 - protein, 949 aa, Homo sapiens
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10313 - protein, 941 aa, Homo sapiens
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10314 - protein, 950 aa, Homo sapiens
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10315 - protein, 948 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10316 - protein, 950 aa, Homo sapiens
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10317 - protein, 947 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10318 - protein, 936 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10319 - protein, 950 aa, Homo sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10320 - protein, 686 aa, Homo sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10321 - protein, 937 aa, Homo sapiens
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVNVYLIIAICAVSSLLVLTLLLYTALRCSAPSSEGACSLVKPTLVCSSAVGSWSFSQQRRQRVCSGEGPPKTDLMAFSPSLPQGPSSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10322 - protein, 950 aa, Homo sapiens
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10323 - protein, 950 aa, Homo sapiens
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10324 - protein, 963 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10325 - protein, 1007 aa, Homo sapiens
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 10326 - protein, 797 aa, Homo sapiens
MKTRGFSFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHSPVFRHKEMVLKISENTAEGTAFRLERAQDPDEGHNSIQNYTISSNSFFHIKISGSDEGMIYPELVLDKALDREEQEELSLTLTALDGGSPSRSGTSTIRIVVLDVNDNAPQFAQALYETQAPENSPVGSLIVKVSAGDADSGVNAEVSYSFFDASEDILTTFQINPFSGEIFLRELLDYELVNSYKINIQAMDGGGLSARCTVLIKVLDSNDNPPELIISSLSNSVAENSPGIVLAVFKIKDRDSGENGKTICYVQDNLPFFLKPSVDNFYILMTEGALDRESKAEYNITITVTDLGTPRLKTEHSITLQVSDVNDNAPAFTQTSYTLFVRENNSPALHIGSVSATDRDSGTNAQVTYSLLPPQDPHLPLASLVSINADNGHLFALRSLDYEALQAFDFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLLSVLLFVAVRLCRRSRAASVGRCSVPEGPFPGHLVDVSGTGTLFQSYQYEVCLTGGSETGEFKFLKPITPHLPPHRGGKEIEENSTLPNSFGFNY

SEQ ID NO: 10327 - protein, 2341 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSKKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 10328 - protein, 136 aa, Homo sapiens
MMDQEEKTEEGSGPCAEAGSPDQEGFFNLLSHVQGDRMEGQRCSLQAGPGQTTKSQSDPTPEMDSLMDMLASTQGRRMDDQRVTVSSLPGFQPVGSKDGAQKRAGTLSPQPLLTPQDPTALGFRRNSSPQPPTQAP

SEQ ID NO: 10329 - protein, 788 aa, Homo sapiens
MDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIPSSSIPLGRQPMAQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 10330 - protein, 748 aa, Homo sapiens
MDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 10331 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 10332 - protein, 429 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYATRANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 10333 - protein, 2839 aa, Homo sapiens
MPITQDNAVLHLPLLYQWLQNSLQEGGDGPEQRLCQAAIQKLQEYIQLNFAVDESTVPPDHSPPEMEICTVYLTKELGDTETVGLSFGNIPVFGDYGEKRRGGKKRKTHQGPVLDVGCIWVTELRKNSPAGKSGKVRLRDEILSLNGQLMVGVDVSGASYLAEQCWNGGFIYLIMLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLAREEVGRIWKMELLKESDGLGIQVSGGRGSKRSPHAIVVTQVKEGGAAHRDGRLSLGDELLVINGHLLVGLSHEEAVAILRSATGMVQLVVASKENSAEDLLRLTSKSLPDLTSSVEDVSSWTDNEDQEADGEEDEGTSSSVQRAMPGTDEPQDVCGAEESKGNLESPKQGSNKIKLKSRLSGGVHRLESVEEYNELMVRNGDPRIRMLEVSRDGRKHSLPQLLDSSSASQEYHIVKKSTRSLSTTQVESPWRLIRPSVISIIGLYKEKGKGLGFSIAGGRDCIRGQMGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPNPKVSEQEMDEVIARSTYQESKEANSSPGLGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKESLGKLTTGDACVSTSCELASALSHLDASHLTENLPKAASELGQQPMTELDSSSDLISSPGKKGAAHPDPSKTSVDTGQVSRPENPSQPASPRVTKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEEDVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 10334 - protein, 519 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 10335 - protein, 129 aa, Homo sapiens
MSHLQSLLLDTLLGTKHVDSAALIKIQERSLCVASPGFNVTPSDVRTLVNGFAKNPLQARREGLYFKGKDYRCVRADEYSLYAKNENTGVVVVKTHLYLLVATYTEGMYPSICVEATESLGDYLRKKGS

SEQ ID NO: 10336 - protein, 922 aa, Homo sapiens
MFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVRFHGGALPAYVVSNILLAYRGQLYSLFSTGCCLEYATMLDKEAKPYKVDPFVIIIKFLLGYKWFKELWDVLLLPELDAVILTCQSMCFPLISLILFLFGTCTAYWSGLLSSASVRLLSSLWLALKRPSELPKDIKMISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLNPDPCKPLAFILIPTMAILGNTYTVSIKSSKLLKTTSQFPLPLAVGVIAFGSAHLYRLPCFVFIPLLLHALCNFM

SEQ ID NO: 10337 - protein, 593 aa, Homo sapiens
MPRTLSLHEITDLLETDDSIEASAIVIQPPENATAPVSDEESGDEEGGTINNLPGSLLHTAAYLIQDGSDAESDSDDPSYAPKDDSPDEVPSTFTVQQPPPSRRRKMTKILCKWKKADLTVQPVAGRVTAPPNDFFTVMRTPTEILELFLDDEVIELIVKYSNLYACSKGVHLGLTSSEFKCFLGIIFLSGYVSVPRRRMFWEQRTDVHNVLVSAAMRRDRFETIFSNLHVADNANLDPVDKFSKLRPLISKLNERCMKFVPNETYFSFDEFMVPYFGRHGCKQFIRGKPIRFGYKFWCGATCLGYICWFQPYQGKNPNTKHEEYGVGASLVLQFSEALTEAHPGQYHFVFNNFFTSIALLDKLSSMGHQATGTVRKDHIDKVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTTFRCEKCDVALHVKCSVEYHTE

SEQ ID NO: 10338 - protein, 1012 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVKPKKKKKKKKKTKPECPCSEEISDTSQEPSPPKAFAVTRCGSSHKPGVHMSPQLHGPESGHHKGKVKALEEDNLSESSSESFLWSDDEYGQDVDVTTNPDEELDGDDRYDFEVVRCICEVQEENDFMIQCEECQCWQHGVCMGLLEENVPEKYTCYVCQDPPGQRPGFKYWYDKEWLSRGHMHGLAFLEENYSHQNAKKIVATHQLLGDVQRVIEVLHGLQLKMSILQSREHPDLPLWCQPWKQHSGEGRSHFRNIPVTDTRSKEEAPSYRTLNGAVEKPRPLALPLPRSVEESYITSEHCYQKPRAYYPAVEQKLVVETRGSALDDAVNPLHENGDDSLSPRLGWPLDQDRSKGDSDPKPGSPKVKEYVSKKALPEEAPARKLLDRGGEGLLSSQHQWQFNLLTHVESLQDEVTHRMDSIEKELDVLESWLDYTGELEPPEPLARLPQLKHCIKQLLMDLGKVQQIALCCST

SEQ ID NO: 10339 - protein, 381 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRDAAWELEPGAFSDLYQRYQHCDAPICLYEQGRDSFEDEGRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 10340 - protein, 342 aa, Homo sapiens
MKTVKEKKECQRLRKSAKTRRVTQRKPSSGPVCWLCLREPGDPEKLGEFLQKDNISVHYFCLILSSKLPQRGQSNRGFHGFLPEDIKKEAARASRKICFVCKKKGAAINCQKDQCLRNFHLPCGQERGCLSQFFGEYKSFCDKHRPTQNIQHGHVGEESCILCCEDLSQQSVENIQSPCCSQAIYHRKCIQKYAHTSAKHFFKCPQCNNRKEFPQEMLRMGIHIPDRRWCLILCATCGSHGTHRDCSSLRSNSKKWECEECSPAAATDYIPENSGDIPCCSSTFHPEEHFCRDNTLEENPGLSWTDWPEPSLLEKPESSRGRRSYSWRSKGVRITNSCKKSK

SEQ ID NO: 10341 - protein, 376 aa, Homo sapiens
MEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSLGTVAEITGHQLMSLSTANAKKDPSCKTCNISVGR

SEQ ID NO: 10342 - protein, 638 aa, Homo sapiens
MEGQSSRGSRRPGTRAGLGSLPMPQGVAQTGAPSKVDSSFQLPAKKNAALGPSEPRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 10343 - protein, 639 aa, Homo sapiens
MALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 10344 - protein, 1102 aa, Homo sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 10345 - protein, 728 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 10346 - protein, 1324 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 10347 - protein, 1463 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 10348 - protein, 4574 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10349 - protein, 4533 aa, Homo sapiens
MAGPLPDEQDFIQAYEEVREKYKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10350 - protein, 4525 aa, Homo sapiens
MDPSRAIQNEISSLKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10351 - protein, 4684 aa, Homo sapiens
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10352 - protein, 4515 aa, Homo sapiens
MKIVPDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10353 - protein, 4547 aa, Homo sapiens
MEPSGSLFPSLVVVGHVVTLAAVWHWRRGRRWAQDEQDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10354 - protein, 4551 aa, Homo sapiens
MSGAGGAFASPREVLLERPCWLDGGCEPARRGYLYQQLCCVDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10355 - protein, 4547 aa, Homo sapiens
MSQHQLRVPQPEGLGRKRTSSEDNLYLAVLRASEGKKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 10356 - protein, 404 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSEHPPGPSESKHAFRPTNAATATSHSTASRSNSLVSTFTMEKRGFYESLAKVKPGNFKVQTVSPREPASKVTEQALLRPQSKNGPQEKDCDLVDLDDASLPVSDV

SEQ ID NO: 10357 - protein, 404 aa, Homo sapiens; identical to SEQ ID NO: 10356

SEQ ID NO: 10358 - protein, 440 aa, Homo sapiens
MEGVLYKWTNYLSGWQPRWFLLCGGILSYYDSPEDAWKGCKGSIQMAVCEIQVHSVDNTRMDLIIPGEQYFYLKARSVAERQRWLVALGSAKACLTDSRTQKEKEFAENTENLKTKMSELRLYCDLLVQQVDKTKEVTTTGVSNSEEGIDVGTLLKSTCNTFLKTLEECMQIANAAFTSELLYRTPPGSPQLAMLKSSKMKHPIIPIHNSLERQMELSTCENGSLNMEINGEEEILMKNKNSLYLKSAEIDCSISSEENTDDNITVQGEIRKEDGMENLKNHDNNLTQSGSDSSCSPECLWEEGKEVIPTFFSTMNTSFSDIELLEDSGIPTEAFLASCYAVVPVLDKLGPTVFAPVKMDLVGNIKKVNQKYITNKEEFTTLQKIVLHEVEADVAQVRNSATEALLWLKRGLKFLKGFLTEVKNGEKDIQTALRNPTENT

SEQ ID NO: 10359 - protein, 1163 aa, Homo sapiens
MPVSTSLHQDGSQERPVSLTSTTSSSGSSCDSRSAMEEPSSSEAPAKNGAGSLRSRHLPNSNNNSSSWLNVKGPLSPFNSRAAAGPAHHKLSYLGRVVREIVETERMYVQDLRSIVESQEFDIYTQYCNNYPNSVAALTECMRDKQQAKFFRDRQELLQHSLPLGSYLLKPVQRILKYHLLLQEIAKHFDEEEDGFEVVEDAIDTMTCVAWYINDMKRRHEHAVRLQEIQSLLINWKGPDLTTYGELVLEGTFRVHRVRNERTFFLFDKTLLITKKRGDHFVYKGNIPCSSLMLIESTRDSLCFTVTHYKHSKQQYSIQAKTVEEKRNWTHHIKRLILENHHATIPQKAKEAILEMDSYYPNRYRCSPERLKKAWSSQDEVSTNVRQGRRQSEPTKHLLRQLNEKARAAGMKGKGRRESESSRSSRRPSGRSPTSTEKRMSFESISSLPEVEPDPEAGSEQEVFSAVEGPSAEETPSDTESPEVLETQLDAHQGLLGMDPPGDMVDFVAAESTEDLKALSSEEEEEMGGAAQEPESLLPPSVLDQASVIAERFVSSFSRRSSVAQEDSKSSGFGSPRLVSRSSSVLSLEGSEKGLARHGSATDSLSCQLSPEVDISVGVATEDSPSVNGMEPPSPGCPVEPDRSSCKKKESALSTRDRLLLDKIKSYYENAEHHDAGFSVRRRESLSYIPKGLVRNSISRFNSLPRPDPEPVPPVGSKRQVGSRPTSWALFELPGPSQAVKGDPPPISDAEFRPSSEIVKIWEGMESSGGSPGKGPGQGQANGFDLHEPLFILEEHELGAITEESATASPESSSPTEGRSPAHLARELKELVKELSSSTQGELVAPLHPRIVQLSHVMDSHVSERVKNKVYQLARQYSLRIKSNKPVMARPPLQWEKVAPERDGKSPTVPCLQEEAGEPLGGKGKRKPVLSLFDYEQLMAQEHSPPKPSSAGEMSPQRFFFNPSAVSQRTTSPGGRPSARSPLSPTETFSWPDVRELCSKYASRDEARRAGGGRPRGPPVNRSHSVPENMVEPPLSGRVGRCRSLSTKRGRGGGEAAQSPGPLPQSKPDGGETLYVTADLTLEDNRRVIVMEKGPLPSPTAGLEESSGQGPSSPVALLGQVQDFQQSAECQPKEEGSRDPADPSQQGRVRNLREKFQALNSVG

SEQ ID NO: 10360 - protein, 1364 aa, Homo sapiens
MAELKVEAPASVDWQKRCLTLETQLFRFRLQASKIRELLADKMQELEQRLLEAEQRAENAETQVGVMEEKVKLSNLKNVDSEGSLHRKYQELLKAIKGKDELISQLEAQLEKQKQMRAEEAKTVQEKAAKIKEWVTLKLAKLEMENQHLKSHNQRLVEQVGSLQDALEAIQIAPSRKLLVPPYGAAEQDSVPSEPGIQPMGQDSGSQAQGLKAAVLAPSPGALQSKDSVSEAASPLEDSSSSTVHSGETVEAKPLQPHLGRESPPHQPCMKLLTFRCSSASWGEGLVTAQRGMLPGTKTSAREGGPGSSLTLPKVRAPGTPRDSIQLAKRHHSQPQVGHGHFGRVVNIETEAFSALHPSGLPELESRARSREEPEKMEMEEPPPAGKNEERESPKALGAELEEVELGNKPPTPPLHQFSSWESRIYAVATSGMRLSDMSPRSNTACCASSPPALVSPGSFSGLVYKNVTVPVYTALKGRATQISNMPFMDESSGSDDDCSSQASFRISVPSSESRKTSGLGSPRAIKRGVSMSSLSSEGDYAIPPDACSLDSDYSEPEHKLQRTSSYSTDGLGLGGESLEKSGYLLKMGSQVKTWKRRWFVLRQGQIMYYKSPSDVIRKPQGQVDLNSRCQIVRGEGSQTFQLISEKKTYYLTADSPSLLEEWIRVLQSLLKVQATGPPALLRGGTKPTVKGWLTKVKHGHSKVVWCALVGKIFYYYRSHEDKRPLGCLPVRDAHIEEVDRSCDSDEDYEAGGTRRLLSSHCTLVIHPTEHSPTYLLIGTKHEKDTWLYHLTVAAGGSSAKVGTAYEQLIGKLMDGEGDPDSPLWRHPMLCYSKDGLYASLTTLPSEALQTEALKLFKSCQLFINVPVEAASVDYHVSLAQTALQVCLVHPELQSEIYCQLMKQTSCRPPQKYSLMQCWQLLALCAPLFLPQHHFLWYVKQQLQRHADPRSETGQYATYCQRAVERTLRTGEREARPSRMEVVSILLRNPFHHSLPFSIPVHFTNGTYHVVGFDGSSTVDEFLQRLNQEIGMRKPSHSGFALFTDDPSGRDLEHCLQGSVKICDAISKWEQAMKELHPGKSEGGTRVVKLMYKNRLYFRSQVKGETDRERLLLASQTSREIVAGRFPINKELALEMAALMAQVEYGDLEKPALPGPGGTSPAKAQHLLQQVLDRFHPRRYRHGAPAEQLRHLADMLTTKWATLQGCSPPECIRIYLTVARKWPFFGAKLFAAQPAQLSSKENALVWIAVNEDGVSILDHNTMQVHITYPYSSVTTFGGCRDDFMLVIRSIPDKSSGKSHIEKLIFRMAAPKIAEATFIMASYMNHCTTTVNPPTNPPGACQLWELDGRQFFSSVSCATKGPTLL

SEQ ID NO: 10361 - protein, 603 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 10362 - protein, 442 aa, Homo sapiens
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 10363 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKGRLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 10364 - protein, 262 aa, Homo sapiens
MAVTAQAARRRERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEDLKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 10365 - protein, 86 aa, Homo sapiens
MTVSVKQLFSTLPVHHKEFQRNIKKKRACFPFAFCRDCQFPEASPAMLPVQPAELTPRSTPPHPCSLEDNVITVFSSVKNGPGSSR

SEQ ID NO: 10366 - protein, 261 aa, Homo sapiens
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 10367 - protein, 139 aa, Homo sapiens
MGGGERYNIPAPQSRNVSKNQQQLNRQKTKEQNSQMKIVHKKKERGHGYNSSAAAWQAMQNGGKNKNFPNNQSWNSSLSGPRLLFKSQANQNYAGAKFSEPPSPSVLPKPPSHWVPVSFNPSDKEIMTFQLKTLLKVQV

SEQ ID NO: 10368 - protein, 1239 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 10369 - protein, 1174 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 10370 - protein, 210 aa, Homo sapiens
MDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQSLVDMAPKYILEQFLQQELLINITEHELVPEHVVMTKEEVTELLARYKLRENQLPRIQAGDPVARYFGIKRGQVVKIIRPSETAGRYITYRLVQ

SEQ ID NO: 10371 - protein, 354 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 10372 - protein, 342 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 10373 - protein, 1024 aa, Homo sapiens
MSNAKERKHAKKMRNQPTNVTLSSGFVADRGVKHHSGGEKPFQAQKQEPHPGTSRQRQTRVNPHSLPDPEVNEQSSSKGMFRKKGGWKAGPEGTSQEIPKYITASTFAQARAAEISAMLKAVTQKSSNSLVFQTLPRHMRRRAMSHNVKRLPRRLQEIAQKEAEKAVHQKKEHSKNKCHKARRCHMNRTLEFNRRQKKNIWLETHIWHAKRFHMVKKWGYCLGERPTVKSHRACYRAMTNRCLLQDLSYYCCLELKGKEEEILKALSGMCNIDTGLTFAAVHCLSGKRQGSLVLYRVNKYPREMLGPVTFIWKSQRTPGDPSESRQLWIWLHPTLKQDILEEIKAACQCVEPIKSAVCIADPLPTPSQEKSQTELPDEKIGKKRKRKDDGENAKPIKKIIGDGTRDPCLPYSWISPTTGIIISDLTMEMNRFRLIGPLSHSILTEAIKAASVHTVGEDTEETPHRWWIETCKKPDSVSLHCRQEAIFELLGGITSPAEIPAGTILGLTVGDPRINLPQKKSNALPNPEKCQDNEKVRQLLLEGVPVECTHSFIWNQDICKSVTENKISDQDLNRMRSELLVPGSQLILGPHESKIPILLIQQPGKVTGEDRLGWGSGWDVLLPKGWGMAFWIPFIYRGVRVGGLKESAVHSQYKRSPNVPGDFPDCPAGMLFAEEQAKNLLEKYKRRPPAKRPNYVKLGTLAPFCCPWEQLTQDWESRVQAYEEPSVASSPNGKESDLRRSEVPCAPMPKKTHQPSDEVGTSIEHPREAEEVMDAGCQESAGPERITDQEASENHVAATGSHLCVLRSRKLLKQLSAWCGPSSEDSRGGRRAPGRGQQGLTREACLSILGHFPRALVWVSLSLLSKGSPEPHTMICVPAKEDFLQLHEDWHYCGPQESKHSDPFRSKILKQKEKKKREKRQKPGRASSDGPAGEEPVAGQEALTLGLWSGPLPRVTLHCSRTLLGFVTQGDFSMAVGCGEALGFVSLTGLLDMVSSQPAAQRGLVLLRPPASLQYRFARIAIEV

SEQ ID NO: 10374 - protein, 448 aa, Homo sapiens
MATTAQYLPRGPGGGAGGTGPLMHPDAAAAAAAAAERLHAGAAYREVQKLMHHEWLGAGAGHPVGLAHPQWLPTGGGGGGDWAGAHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPAAGAGHPPMDDVYAPGELGPGGGGASPPSAPPPPPPAALHHHHHHTLPGSVQ

SEQ ID NO: 10375 - protein, 1257 aa, Homo sapiens
MMCEVMPTINEDTPMSQRGSQSSGSDSDSHFEQLMVNMLDERDRLLDTLRETQESLSLAQQRLQDVIYDRDSLQRQLNSALPQDIESLTGGLAGSKGADPPEFAALTKELNACREQLLEKEEEISELKAERNNTRLLLEHLECLVSRHERSLRMTVVKRQAQSPSGVSSEVEVLKALKSLFEHHKALDEKVRERLRVSLERVSALEEELAAANQEIVALREQNVHIQRKMASSEGSTESEHLEGMEPGQKVHEKRLSNGSIDSTDETSQIVELQELLEKQNYEMAQMKERLAALSSRVGEVEQEAETARKDLIKTEEMNTKYQRDIREAMAQKEDMEERITTLEKRYLSAQRESTSIHDMNDKLENELANKEAILRQMEEKNRQLQERLELAEQKLQQTMRKAETLPEVEAELAQRIAALTKAEERHGNIEERMRHLEGQLEEKNQELQRARQREKMNEEHNKRLSDTVDRLLTESNERLQLHLKERMAALEEKNVLIQESETFRKNLEESLHDKERLAEEIEKLRSELDQLKMRTGSLIEPTIPRTHLDTSAELRYSVGSLVDSQSDYRTTKVIRRPRRGRMGVRRDEPKVKSLGDHEWNRTQQIGVLSSHPFESDTEMSDIDDDDRETIFSSMDLLSPSGHSDAQTLAMMLQEQLDAINKEIRLIQEEKESTELRAEEIENRVASVSLEGLNLARVHPGTSITASVTASSLASSSPPSGHSTPKLTPRSPAREMDRMGVMTLPSDLRKHRRKIAVVEEDGREDKATIKCETSPPPTPRALRMTHTLPSSYHNDARSSLSVSLEPESLGLGSANSSQDSLHKAPKKKGIKSSIGRLFGKKEKARLGQLRGFMETEAAAQESLGLGKLGTQAEKDRRLKKKHELLEEARRKGLPFAQWDGPTVVAWLELWLGMPAWYVAACRANVKSGAIMSALSDTEIQREIGISNPLHRLKLRLAIQEMVSLTSPSAPPTSRTPSGNVWVTHEEMENLAAPAKTKESEEGSWAQCPVFLQTLAYGDMNHEWIGNEWLPSLGLPQYRSYFMECLVDARMLDHLTKKDLRVHLKMVDSFHRTSLQYGIMCLKRLNYDRKELERRREASQHEIKDVLVWSNDRVIRWIQAIGLREYANNILESGVHGSLIALDENFDYSSLALLLQIPTQNTQARQILEREYNNLLALGTERRLDESDDKNFRRGSTWRRQFPPREVHGISMMPGSSETLPAGFRLTTTSGQSRKMTTDVASSRLQRLDNSTVRTYSC

SEQ ID NO: 10376 - protein, 480 aa, Homo sapiens
MIRAAPPPLFLLLLLLLLLVSWASRGEAAPDQDEIQRLPGLAKQPSFRQYSGYLKSSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 10377 - protein, 799 aa, Homo sapiens
MARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 10378 - protein, 467 aa, Homo sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 10379 - protein, 1160 aa, Homo sapiens
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 10380 - protein, 1156 aa, Homo sapiens
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSEPTASAPSSAQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 10381 - protein, 1061 aa, Homo sapiens
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 10382 - protein, 1023 aa, Homo sapiens
MSAYSVPSTFAQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 10383 - protein, 199 aa, Homo sapiens
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGEVCPAGWKPGSDTIKPDVQKSKEYFSKQK

SEQ ID NO: 10384 - protein, 199 aa, Homo sapiens; identical to SEQ ID NO: 10383

SEQ ID NO: 10385 - protein, 199 aa, Homo sapiens; identical to SEQ ID NO: 10383

SEQ ID NO: 10386 - protein, 256 aa, Homo sapiens
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 10387 - protein, 238 aa, Homo sapiens
MAAAVGRLLRASVARHVSAIPWGISATAALRPAACGRTSLTNLLCSGSSQAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 10388 - protein, 552 aa, Homo sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 10389 - protein, 1160 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 10390 - protein, 1188 aa, Homo sapiens
MHPQSLAEEEIKTEQEVVEGMDISTRSKDPGSAERTAQKRKFPSPPHSSNGHSPQDTSTSPIKKKKKPGLLNSNNKEQSELRHGPFYYMKQPLTTDPVDVVPQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSVSKRCDKQPAYAPTTTDHQPHPNYPAQKYHSRSNKSSWSSSDEKRGSTRSDHNTSTSTKSLLPKESRLDTFWD

SEQ ID NO: 10391 - protein, 1135 aa, Homo sapiens
MHPQSLAEEEIKTEQEVVEGMDISTRSKDPGSAERTAQKRKFPSPPHSSNGHSPQDTSTSPIKKKKKPGLLNSNNKEQDGRNDFYCWVCHREGQVLCCELCPRVYHAKCLRLTSEPEGDWFCPECEKITVAECIETQSKAMTMLTIEQLSYLLKFAIQKMKQPGTDAFQKPVPLEQHPDYAEYIFHPMDLCTLEKNAKKKMYGCTEAFLADAKWILHNCIIYNGGNHKLTQIAKVVIKICEHEMNEIEVCPECYLAACQKRDNWFCEPCSNPHPLVWAKLKGFPFWPAKALRDKDGQVDARFFGQHDRAWVPINNCYLMSKEIPFSVKKTKSIFNSAMQEMEVYVENIRRKFGVFNYSPFRTPYTPNSQYQMLLDPTNPSAGTAKIDKQEKVKLNFDMTASPKILMSKPVLSGGTGRRISLSDMPRSPMSTNSSVHTGSDVEQDAEKKATSSHFSASEESMDFLDKSTASPASTKTGQAGSLSGSPKPFSPQLSAPITTKTDKTSTTGSILNLNLDRSKAEMDLKELSESVQQQSTPVPLISPKRQIRSRFQLNLDKTIESCKAQLGINEISEDVYTAVEHSDSEDSEKSDSSDSEYISDDEQKSKNEPEDTEDKEGCQMDKEPSAVKKKPKPTNPVEIKEELKSTSPASEKADPGAVKDKASPEPEKDFSEKAKPSPHPIKDKLKGKDETDSPTVHLGLDSDSESELVIDLGEDHSGREGRKNKKEPKEPSPKQDVVGKTPPSTTVGSHSPPETPVLTRSSAQTSAAGATATTSTSSTVTVTAPAPAATGSPVKKQRPLLPKETAPAVQRVVWNSSTVQQKEITQSPSTSTITLVTSTQSSPLVTSSGSMSTLVSSVNADLPIATASADVAADIAKYTSKMMDAIKGTMTEIYNDLSKNTTGSTIAEIRRLRIEIEKLQWLHQQELSEMKHNLELTMAEMRQSLEQERDRLIAEVKKQLELEKQQAVDETKKKQWCANCKKEAIFYCCWNTSYCDYPCQQAHWPEHMKSCTQSATAPQQEADAEVNTETLNKSSQGSSSSTQSAPSETASASKEKETSAEKSKESGSTLDLSGSRETPSSILLGSNQGSDHSRSNKSSWSSSDEKRGSTRSDHNTSTSTKSLLPKESRLDTFWD

SEQ ID NO: 10392 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 10393 - protein, 4128 aa, Homo sapiens [sequence omitted]

SEQ ID NO: 10394 - protein, 2335 aa, Homo sapiens
MAGVFPYRGPGNPVPGPLAPLPDYMSEEKLQEKARKWQQLQAKRYAEKRKFGFVDAQKEDMPPEHVREIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILNVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEGWLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRVCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEETVAVYTTTVHWLESRRFSPIPFPPLSYKHDTKLLILALERLKEAYSVKSRLNQSQREELGLIEQAYDNLHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLVRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 10395 - protein, 253 aa, Homo sapiens
MPGRTEGGSWLRNAAAADVLRNLPEVEWREPQHCCPPTPRKRKQNPRVPLPHYPPNPAAAIAADTMPKRKKQNHHQPPTQQQPPLPEREETGDEEDGSPIGPPSLLGPPPMANGKPGDPKSALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 10396 - protein, 274 aa, Homo sapiens
MVMSQGTYTFLTCFAGFWLIWGLIVLLCCFCSFLRRRLKRRQEERLREQNLRALELEPLELEGSLAGSPPGLAPPQPPPHRSRLEAPAHAHSHPHVHVHPLLHHGPAQPHAHAHPHPHHHALPHPPPTHLSVPPRPWSYPRQAESDMSKPPCYEEAVLMAEPPPPYSEVLTDTRGLYRKIVTPFLSRRDSAEKQEQPPPSYKPLFLDRGYTSALHLPSAPRPAPPCPALCLQADRGRRVFPSWTDSELSSREPLEHGAWRLPVSIPLFGRTTAV

SEQ ID NO: 10397 - protein, 394 aa, Homo sapiens
MDLCHPEPAELSSGETEELQRIKWHRKQLLEDIQKLKDEIADVFAQIDCFESAEESRMAQKEKELCIGRKKFNMDPAKGIQYFIEHKLLTPDVQDIARFLYKGEGLNKTAIGTYLGERDPINLQVLQAFVDCHEFANLNLVQALRQFLWSFRLPGEAQKIDRMMEAFATRYCLCNPGVFQSTDTCYVLSFSIIMLNTSLHNPNVRDRPPFERFVSMNRGINNGSDLPEDQLRNLFDSIKSEPFSIPEDDGNDLTHTFFNPDREGWLLKLGGRVKTWKRRWFILTDNCLYYFEFTTDKEPRGIIPLENLSVQKVDDPKKPFCLELYNPSCRGQKIKACKTDGDGRVVEGKHESYRISATSAEERDQWIESIRASITRVPFYDLVSTRKKKIASKQ

SEQ ID NO: 10398 - protein, 333 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEGKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 10399 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 10400 - protein, 269 aa, Homo sapiens
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 10401 - protein, 376 aa, Homo sapiens
MKDVPGFLQQSQSSGPGQPAVWHRLEELYTKKLWHQLTLQVLDFVQDPCFAQGDGLIKLYENFISEFEHRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 10402 - protein, 351 aa, Homo sapiens
MVSLSFMKTLSVNLNTGKSLSSVFHFGDEYIDARWCSKTGGFYFRVNPLSLVEIILHVVRQMTDPNVALTFLEKTREKVKSSDEAVILCKTAIGALKLNIGDLQVTKETIEDVEEMLNNLPGVTSVHSRFYDLSSKYYQTIGNHASYYKDALRFLGCVDIKDLPVSEQQERAFTLGLAGLLGEGVFNFGELLMHPVLESLRNTDRQWLIDTLYAFNSGNVERFQTLKTAWGQQPDLAANEAQLLRKIQLLCLMEMTFTRPANHRQLTFEEIAKSAKITVNEVELLVMKALSVGLVKGSIDEVDKRVHMTWVQPRVLDLQQIKGMKDRLEFWCTDVKSMEMLVEHQAHDILT

SEQ ID NO: 10403 - protein, 534 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 10404 - protein, 249 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 10405 - protein, 250 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYVRRQGQGRGGQRQLSQATHSLTLQARG

SEQ ID NO: 10406 - protein, 887 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 10407 - protein, 1074 aa, Homo sapiens
MISADCNLCLPEYDRYLASSKIMAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 10408 - protein, 1052 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 10409 - protein, 168 aa, Homo sapiens
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 10410 - protein, 1997 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFKIISLDEERTVVLQTDPLPPARFGVSKEKTTSTGLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLSPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKRDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 10411 - protein, 1445 aa, Homo sapiens
MRRLLEPCWWILFLKITSSVLHYVVCFPALTEGYVGALHENRHGSAVQIRRRKASGDPYWAYSGAYGPEHWVTSSVSCGSRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKARLSLVSTKENGNGPMTVDKNGAVLIADESDPAESMESLV

SEQ ID NO: 10412 - protein, 1115 aa, Homo sapiens
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRNLRVEAQTTSSISLSWEVPDGTDPQNSTYCVQCTGDGGRTETRNTTDTRVTVDGLGPGSLYTCSVWVEKDGVNSSVEIVTSATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 10413 - protein, 1440 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 10414 - protein, 1015 aa, Homo sapiens
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 10415 - protein, 998 aa, Homo sapiens
MGPPLPLLLLLLLLLPPRVLPAAPSSVPRGRQLPGRLDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLNGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 10416 - protein, 986 aa, Homo sapiens
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGPRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDREVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 10417 - protein, 1188 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 10418 - protein, 1216 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 10419 - protein, 377 aa, Homo sapiens
MVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 10420 - protein, 405 aa, Homo sapiens
MVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 10421 - protein, 377 aa, Homo sapiens; identical to SEQ ID NO: 10419

SEQ ID NO: 10422 - protein, 405 aa, Homo sapiens; identical to SEQ ID NO: 10420

SEQ ID NO: 10423 - protein, 701 aa, Homo sapiens
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRIVDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFQNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 10424 - protein, 403 aa, Homo sapiens
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 10425 - protein, 200 aa, Homo sapiens
MAKKTYDLLFKLLLIGDSGVGKTCVLFRFSDDAFNTTFISTIGIDFKIKTVELQGKKIKLQIWDTAGQERFHTITTSYYRGAMGIMLVYDITNGKSFENISKWLRNIDEHANEDVERMLLGNKCDMDDKRVVPKGKGGQIAREHGIRFFETSAKANINIEKAFLTLAEDILRKTPVKEPNSENVDISSGGGVTGWKSKCC

SEQ ID NO: 10426 - protein, 637 aa, Homo sapiens
MAGGAGWSGAPAALLRSVRRLREVFEVCGRDPDGFLRVERVAALGLRFGQGEEVEKLVKYLDPNDLGRINFKDFCRGVFAMKGCEELLKDVLSVESAGTLPCAPEIPDCVEQGSEVTGPTFADGELIPREPGFFPEDEEEAMTLAPPEGPQELYTDSPMESTQSLEGSVGSPAEKDGGLGGLFLPEDKSLVHTPSMTTSDLSTHSTTSLISNEEQFEDYGEGDDVDCAPSSPCPDDETRTNVYSDLGSSVSSSAGQTPRKMRHVYNSELLDVYCSQCCKKINLLNDLEARLKNLKANSPNRKISSTAFGRQLMHSSNFSSSNGSTEDLFRDSIDSCDNDITEKVSFLEKKVTELENDSLTNGDLKSKLKQENTQLVHRVHELEEMVKDQETTAEQALEEEARRHREAYGKLEREKATEVELLNARVQQLEEENTELRTTVTRLKSQTEKLDEERQRMSDRLEDTSLRLKDEMDLYKRMMDKLRQNRLEFQKEREATQELIEDLRKELEHLQMYKLDCERPGRGRSASSGLGEFNARAREVELEHEVKRLKQENYKLRDQNDDLNGQILSLSLYEAKNLFAAQTKAQSLAAEIDTASRDELMEALKEQEEINFRLRQYMDKIILAILDHNPSILEIKH

SEQ ID NO: 10427 - protein, 208 aa, Homo sapiens
MSTGGDFGNPLRKFKLVFLGEQSVGKTSLITRFMYDSFDNTYQATIGIDFLSKTMYLEDRTIRLQLWDTAGQERFRSLIPSYIRDSAAAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 10428 - protein, 208 aa, Homo sapiens
MSTGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNVNSFQQTTKWIDDVRTERGSDVIIMLVGNKTDLADKRQVSIEEGERKAKELNVMFIETSAKAGYNVKQLFRRVAAALPGMESTQDRSREDMIDIKLEKPQEQPVSEGGCSC

SEQ ID NO: 10429 - protein, 185 aa, Homo sapiens
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPEHQYALAGGISFPFFWLAGAGSAVFWVLGATLVVIGSHAAFHQIEAVDGEELQMEPV

SEQ ID NO: 10430 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAYGNS

SEQ ID NO: 10431 - protein, 384 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQETTFCSVTQAELNWAPEILPPQPPEQLGLQMCHHTQLIF

SEQ ID NO: 10432 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQGQEKP

SEQ ID NO: 10433 - protein, 391 aa, Homo sapiens
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 10434 - protein, 578 aa, Homo sapiens
MGCGLNKLEKRDEKRPGNIYSTLKRPQVETKIDVSYEYRFLEFTTLSAAELPGSSAVRLASLRDLPAQLLELYQQGFSLAALHPFVQPTHEREKTPLEHIFRAILIKKTDRSQKTDLHNEGYILELDCCSSLDHPTDQKLIPEFIKKIQEAASQGLKFVGVIPQYHSSVNSAGSSAPVSTANSTEDARDAKNARGDHASLENEKPGTGDVCSAPAGRNQSPEPSSGPRGEVPLAKQPSSPSGEGDGGELSPQGVSKTLDGPESNPLEVHEEPLSGKMEIFTLFNKPKSHQKCRQYYPVTIPLHVSKNGQTVSGLDANWLEHMSDHFRKGGMLVNAVFYLGIVNDSLHGLTDGVFIFEAVSTEDSKTIQGYDAIVVEQWTVLEGVEVQTDYVPLLNSLAAYGWQLTCVLPTPVVKTTSEGSVSTKQIVFLQRPCLPQKIKKKESKFQWRFSREEMHNRQMRKSKGKLSARDKQQAEENEKNLEDQSSKAGDMGNCVSGQQQEGGVSEEMKGPVQEDKGEQLSPGGLLCGVGVEGEAVQNGPASHSRALVGICTGHSNPGEDARDGDAEEVRELGTVEEN

SEQ ID NO: 10435 - protein, 1906 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGTHFPQHSQSFPTSSTYSSSVQGGGQGAHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNSKKLSSTDCFKTEAFTSPEALQPGGTALAPKKRSRKGRAGAHGLSKGPLEKRPYLGPALLLTPRDRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGRKHECSKEAPAEPGGEAQEHWVHEACAVWTGGVYLVAGKLFGLQEAMKVAVDMMCSSCQEAGATIGCCHKGCLHTYHYPCASDAGCIFIEENFSLKCPKHKRLP

SEQ ID NO: 10436 - protein, 440 aa, Homo sapiens
MPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 10437 - protein, 1115 aa, Homo sapiens
MPEDQVGKLEATENTISAMAAAAAEQQQFYLLLGNLLSPDNVVRKQAEETYENIPGQSKITFLLQAIRNTTAAEEARQMAAVLLRRLLSSAFDEVYPALPSDVQTAIKSELLMIIQMETQSSMRKKVCDIAAELARNLIDEDGNNQWPEGLKFLFDSVSSQNVGLREAALHIFWNFPGIFGNQQQHYLDVIKRMLVQCMQDQEHPSIRTLSARATAAFILANEHNVALFKHFADLLPGFLQAVNDSCYQNDDSVLKSLVEIADTVPKYLRPHLEATLQLSLKLCGDTSLNNMQRQLALEVIVTLSETAAAMLRKHTNIVAQTIPQMLAMMVDLEEDEDWANADELEDDDFDSNAVAGESALDRMACGLGGKLVLPMIKEHIMQMLQNPDWKYRHAGLMALSAIGEGCHQQMEGILNEIVNFVLLFLQDPHPRVRYAACNAVGQMATDFAPGFQKKFHEKVIAALLQTMEDQGNQRVQAHAAAALINFTEDCPKSLLIPYLDNLVKHLHSIMVLKLQELIQKGTKLVLEQVVTSIASVADTAEEKFVPYYDLFMPSLKHIVENAVQKELRLLRGKTIECISLIGLAVGKEKFMQDASDVMQLLLKTQTDFNDMEDDDPQISYMISAWARMCKILGKEFQQYLPVVMGPLMKTASIKPEVALLDTQDMENMSDDDGWEFVNLGDQQSFGIKTAGLEEKSTACQMLVCYAKELKEGFVEYTEQVVKLMVPLLKFYFHDGVRVAAAESMPLLLECARVRGPEYLTQMWHFMCDALIKAIGTEPDSDVLSEIMHSFAKCIEVMGDGCLNNEHFEELGGILKAKLEEHFKNQELRQVKRQDEDYDEQVEESLQDEDDNDVYILTKVSDILHSIFSSYKEKVLPWFEQLLPLIVNLICPHRPWPDRQWGLCIFDDVIEHCSPASFKYAEYFLRPMLQYVCDNSPEVRQAAAYGLGVMAQYGGDNYRPFCTEALPLLVRVIQSADSKTKENVNATENCISAVGKIMKFKPDCVNVEEVLPHWLSWLPLHEDKEEAVQTFNYLCDLIESNHPIVLGPNNTNLPKIFSIIAEGEMHEAIKHEDPCAKRLANVVRQVQTSGGLWTECIAQLSPEQQAAIQELLNSA

SEQ ID NO: 10438 - protein, 803 aa, Homo sapiens
MAKRSSLYIRIVEGKNLPAKDITGSSDPYCIVKVDNEPIIRTATVWKTLCPFWGEEYQVHLPPTFHAVAFYVMDEDALSRDDVIGKVCLTRDTIASHPKGFSGWAHLTEVDPDEEVQGEIHLRLEVWPGARACRLRCSVLEARDLAPKDRNGTSDPFVRVRYKGRTRETSIVKKSCYPRWNETFEFELQEGAMEALCVEAWDWDLVSRNDFLGKVVIDVQRLRVVQQEEGWFRLQPDQSKSRRHDEGNLGSLQLEVRLRDETVLPSSYYQPLVHLLCHEVKLGMQGPGQLIPLIEETTSTECRQDVATNLLKLFLGQGLAKDFLDLLFQLELSRTSETNTLFRSNSLASKSMESFLKVAGMQYLHGVLGPIINKVFEEKKYVELDPSKVEVKDVGCSGLHRPQTEAEVLEQSAQTLRAHLGALLSALSRSVRACPAVVRATFRQLFRRVRERFPGAQHENVPFIAVTSFLCLRFFSPAIMSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKMPSSKKSALIKLANIRAAEKVEEKSFGGSHVMQVIYTDDAGRPQTAYLQCKCVNELNQWLSALRKVSINNTGLLGSYHPGVFRGDKWSCCHQKEKTGQGCDKTRSRVTLQEWNDPLDHDLEAQLIYRHLLGVEAMLWERHRELSGGTEAGTVPTSPGKVPEDSLARLLRVLQDLREAHSSSPAGSPPSEPNCLLELQT

SEQ ID NO: 10439 - protein, 797 aa, Homo sapiens
MGTLGKAREAPRKPSHGCRAASKARLEAKPANSPFPSHPSLAHITQFRMMVSLGHLAKGASLDDLIDSCIQSFDADGNLCRSNQLLQVMLTMHRIVISSAELLQKVITLYKDALAKNSPGLCLKICYFVRYWITEFWVMFKMDASLTDTMEEFQELVKAKGEELHCRLIDTTQINARDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIQVAQKLHQLQNFNTLMAVIGGLCHSSISRLKETSSHVPHEINKVLGEMTELLSSSRNYDNYRRAYGECTDFKIPILGVHLKDLISLYEAMPDYLGDGKVNVHKLLALYNHISELVQLQEVAPPLEANKDLVHLLTLSLDLYYTEDEIYELSYAREPRNHRAPPLTPSKPPVVVDWASGVSPKPDPKTISKHVQRMVDSVFKNYDHDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRAKNPVAPTENNTSVGPVSNLCSLGAKDLLHAPEEGPFTFPNGEAVEHGEESKDRTIMLMGVSSQKISLRLKRAVAHKATQTESQPWIGSEGPSGPFVLSSPRKTAQDTLYVLPSPTSPCPSPVLVRKRAFVKWENKDSLIKSKEELRHLRLPTYQELEQEINTLKADNDALKIQLKYAQKKIESLQLEKSNHVLAQMEQGDCS

SEQ ID NO: 10440 - protein, 203 aa, Homo sapiens
MVSTYRVAVLGARGVGKSAIVRQFLYNEFSEVCVPTTARRLYLPAVVMNGHVHDLQILDFPPISAFPVNTLQEWADTCCRGLRSVHAYILVYDICCFDSFEYVKTIRQQILETRVIGTSETPIIIVGNKRDLQRGRVIPRWNVSHLVRKTWKCGYVECSAKYNWHILLLFSELLKSVGCARCKHVHAALRFQGALRRNRCAIM

SEQ ID NO: 10441 - protein, 425 aa, Homo sapiens
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 10442 - protein, 425 aa, Homo sapiens
MSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 10443 - protein, 1133 aa, Homo sapiens
MPVQAPQWTDFLSCPICTQTFDETIRKPISLGCGHTVCKMCLNKLHRKACPFDQTTINTDIELLPVNSALLQLVGAQVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPAMQEEALKLVLLALEDGSALSRKVLVLFVVQRLEPRFPQASKTSIGHVVQLLYRASCFKVTKRDEDSSLMQLKEEFRTYEALRREHDSQIVQIAMEAGLRIAPDQWSSLLYGDQSHKSHMQSIIDKLQTPASFAQSVQELTIALQRTGDPANLNRLRPHLELLANIDPSPDAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEAVSNRLVLQREANTLAGQSQPPPPPPPKWPGMISSEQLSLELHQVEREIGKRTRELSMENQCSLDMKSKLNTSKQAENGQPEPQNKVPAEDLTLTFSDVPNGSALTQENISLLSNKTSSLNLSEDPEGGGDNNDSQRSGVTPSSAP

SEQ ID NO: 10444 - protein, 421 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 10445 - protein, 495 aa, Homo sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 10446 - protein, 260 aa, Homo sapiens
MEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGSGVTVNALHPGVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 10447 - protein, 1363 aa, Homo sapiens
MSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 10448 - protein, 443 aa, Homo sapiens
MYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMQAKAIDPQETTKKSSTLPFMRRHLRSSPSPVILRQLEEEAKAREAANTVDITQPGQHMAPSPHLTVYTGTCMPPSPSSPFSSSCRSPRKPFASPSRFIRRPTICPSPILVVLDSSSGLEQKGECSWSGANPGPSVTDSSEASRDTSWTRSRPRAPLKARMALSFSRFLRRGCLASPVFARVSPKCPAVSHGRVQPLGDVGQQLPRLKSKRVANFFQIKMDVPTGSGTCLMDSEDAGTGESGDRATEKEVICPWESL

SEQ ID NO: 10449 - protein, 315 aa, Homo sapiens
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 10450 - protein, 1708 aa, Homo sapiens
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKLKVDYLIARCIDIQQSNEVERTQALRLVRKMITVNASLFPSSVTNSLIAVGNDGLQERDRMVRACIAIICELALQNPEVVALRGGLNTILKNVIDCQLSRINEALITTILHLLNHPKTRQYVRADVELERILAPYTDFHYRHSPDTAEGQLKEDREARFLASKMGIIATFRSWAGIINLCKPGNSGIQSLIGVLCIPNMEIRRGLLEVLYDIFRLPLPVVTEEFIEALLSVDPGRFQDSWRLSDGFVAAEAKTILPHRARSRPDLMDNYLALILSAFIRNGLLEGLVEVITNSDDHISVRATILLGELLHMANTILPHSHSHHLHCLPTLMNMAASFDIPKEKRLRASAALNCLKRFHEMKKRGPKPYSLHLDHIIQKAIATHQKRDQYLRVQKDIFILKDTEEALLINLRDSQVLQHKENLEWNWNLIGTILKWPNVNLRNYKDEQLHRFVRRLLYFYKPSSKLYANLDLDFAKAKQLTVVGCQFTEFLLESEEDGQGYLEDLVKDIVQWLNASSGMKPERSLQNNGLLTTLSQHYFLFIGTLSCHPHGVKMLEKCSVFQCLLNLCSLKNQDHLLKLTVSSLDYSRDGLARVILSKILTAATDACRLYATKHLRVLLRANVEFFNNWGIELLVTQLHDKNKTISSEALDILDEACEDKANLHALIQMKPALSHLGDKGLLLLLRFLSIPKGFSYLNERGYVAKQLEKWHREYNSKYVDLIEEQLNEALTTYRKPVDGDNYVRRSNQRLQRPHVYLPIHLYGQLVHHKTGCHLLEVQNIITELCRNVRTPDLDKWEEIKKLKASLWALGNIGSSNWGLNLLQEENVIPDILKLAKQCEVLSIRGTCVYVLGLIAKTKQGCDILKCHNWDAVRHSRKHLWPVVPDDVEQLCNELSSIPSTLSLNSESTSSRHNSESESVPSSMFILEDDRFGSSSTSTFFLDINEDTEPTFYDRSGPIKDKNSFPFFASSKLVKNRILNSLTLPNKKHRSSSDPKGGKLSSESKTSNRRIRTLTEPSVDFNHSDDFTPISTVQKTLQLETSFMGNKHIEDTGSTPSIGENDLKFTKNFGTENHRENTSRERLVVESSTSSHMKIRSQSFNTDTTTSGISSMSSSPSRETVGVDATTMDTDCGSMSTVVSTKTIKTSHYLTPQSNHLSLSKSNSVSLVPPGSSHTLPRRAQSLKAPSIATIKSLADCNFSYTSSRDAFGYATLKRLQQQRMHPSLSHSEALASPAKDVLFTDTITMKANSFESRLTPSRFMKALSYASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASSTKSTELLLGVKTIPDDTPMCRILLRKEVLRLVINLSSSVSTKCHETGLLTIKEKYPQTFDDICLYSEVSHLLSHCTFRLPCRRFIQELFQDVQFLQMHEEAEAVLATPPKQPIVDTSAES

SEQ ID NO: 10451 - protein, 929 aa, Homo sapiens
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPVGTREIKCCIRQIQELIISRLNQAVANKLISSVDYLRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGKYDNSVDVYAFGILFWYICSGSVKLPEAFERCASKDHLWNNVRRGARPERLPVFDEECWQLMEACWDGDPLKRPLLGIVQPMLQGIMNRLCKSNSEQPNRGLDDST

SEQ ID NO: 10452 - protein, 884 aa, Homo sapiens
MEGDGVPWGSEPVSGPGPGGGGMIRELCRGFGRYRRYLGRLRQNLRETQKFFRDIKCSHNHTCLSSLTGGGGAERGPAGDVAETGLQAGQLSCISFPPKEEKYLQQIVDCLPCILILGQDCNVKCQLLNLLLGVQVLPTTKLGSEESCKLRRLRFTYGTQTRVSLALPGQYELVHTLVAHQGNWETIPEEDLEVQENNEDAAHVLAELEVTMHHALLQEVDVVVAPCQGLRPTVDVLGDLVNDFLPVITYALHKDELSERDEQELQEIRKYFSFPVFFFKVPKLGSEIIDSSTRRMESERSPLYRQLIDLGYLSSSHWNCGAPGQDTKAQSMLVEQSEKLRHLSTFSHQVLQTRLVDAAKALNLVHCHCLDIFINQAFDMQRDLQITPKRLEYTRKKENELYESLMNIANRKQEEMKDMIVETLNTMKEELLDDATNMEFKDVIVPENGEPVGTREIKCCIRQIQELIISRLNQAVANKLISSVDYLRESFVGTLERCLQSLEKSQDVSVHITSNYLKQILNAAYHVEVTFHSGSSVTRMLWEQIKQIIQRITWVSPPAITLEWKRKVAQEAIESLSASKLAKSICSQFRTRLNSSHEAFAASLRQLEAGHSGRLEKTEDLWLRVRKDHAPRLARLSLESCSLQDVLLHRKPKLGQELGRGQYGVVYLCDNWGGHFPCALKSVVPPDEKHWNDLALEFHYMRSLPKHERLVDLHGSVIDYNYGGGSSIAVLLIMERLHRDLYTGLKAGLTLETRLQIALDVVEGIRFLHSQGLVHRDIKLKNVLLDKQNRAKITDLGFCKPEAMMSGSIVGTPIHMAPELFTGARPERLPVFDEECWQLMEACWDGDPLKRPLLGIVQPMLQGIMNRLCKSNSEQPNRGLDDST

SEQ ID NO: 10453 - protein, 1374 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGRSYGLSVVPEPAGCTPELPGEIIKNTDSWAPPLEIVNHRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDPFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYTDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 10454 - protein, 685 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 10455 - protein, 346 aa, Homo sapiens
MVLVHVGYLVLPVFGSVRNRGAPFQRSQHPHATSCRHFHLGPPQPQQLAPDFPLAHPVQSQPGLSAHMAPAHQHSGALHQSLTPLPTLQFQDVTGPSFLPQALHQQYLLQQQLLEAQHRRLVSHPRRSQERVSVHPHRLHPSFDFGQLQTPQPRYLAEGTDWDLSVDAGLSPAQFQVRPIPQHYQHYLATPRMHHFPRNSSSTQMVVHEIRNYPYPQLHFLALQGLNPSRHTSAVRESYEELLQLEDRLGNVTRGAVQNTIERFTFPHKYKKRRPQDGKGKKDEGEESDTDEKCTICLSMLEDGEDVRRLPCMHLFHQLCVDQWLAMSKKCPICRVDIETQLGADS

SEQ ID NO: 10456 - protein, 328 aa, Homo sapiens
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIMFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVFHEFCIRGWCIVGKKQTCPYCKEKVDLKRMISNPWERTHFLYGQILDWLRYLVAWQPVVIGIVQGINYSLGLE

SEQ ID NO: 10457 - protein, 416 aa, Homo sapiens
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMVSIYLLI

SEQ ID NO: 10458 - protein, 461 aa, Homo sapiens [sequence omitted]

SEQ ID NO: 10459 - protein, 461 aa, Homo sapiens [sequence omitted]

SEQ ID NO: 10460 - protein, 461 aa, Homo sapiens [sequence omitted]

SEQ ID NO: 10461 - protein, 461 aa, Homo sapiens [sequence omitted]

SEQ ID NO: 10462 - protein, 461 aa, Homo sapiens [sequence omitted]

SEQ ID NO: 10463 - protein, 461 aa, Homo sapiens [sequence omitted]

SEQ ID NO: 10464 - protein, 461 aa, Homo sapiens [sequence omitted]

SEQ ID NO: 10465 - protein, 461 aa, Homo sapiens [sequence omitted]

SEQ ID NO: 10466 - protein, 420 aa, Homo sapiens
MAALVRPARFVVRPLLQVVQAWDLDARRWVRALRRSPVKVVFPSGEVVEQKRAPGKQPRKAPSEASAQEQREKQPLEESASRAPSTWEESGLRYDKAYPGDRRLSSVMTIVKSRPFREKQGKILLEGRRLISDALKAGAVPKMFFFSRLEYLKELPVDKLKGVSLIKVKFEDIKDWSDLVTPQGIMGIFAKPDHVKMTYPKTQLQHSLPLLLICDNLRDPGNLGTILRSAAGAGCSKVLLTKGCVDAWEPKVLRAGMGAHFRMPIINNLEWETVPNYLPPDTRVYVADNCGLYAQAEMSNKASDHGWVCDQRVMKFHKYEEEEDVETGASQDWLPHVEVQSYDSDWTEAPAAVVIGGETYGVSLESLQLAESTGGKRLLIPVVPGVDSLNSAMAASILLFEGKRQLRGRAEDLSRDRSYH

SEQ ID NO: 10467 - protein, 650 aa, Homo sapiens
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 10468 - protein, 548 aa, Homo sapiens
MNEGAPGDSDLETEARVPWSIMGHCLRTGQARMSATPTPAGEGARSSSTCSSLSRLFWSQLEHINWDGATAKNFINLREFFSFLLPALRKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 10469 - protein, 556 aa, Homo sapiens
MNEGAPGDSDLETEARVPWSIMGHCLRTGQARMSATPTPAGEGARRDELFGILQILHQCILSSGDAFVLTGVCCSWRQNGKPPYSQKEDKEVQTGYMNAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 10470 - protein, 523 aa, Homo sapiens
MESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 10471 - protein, 468 aa, Homo sapiens
MMYFVIAAMKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 10472 - protein, 459 aa, Homo sapiens
MRAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQQQSGEAEALARVYSSSISNGLSNLNNETSGTYANGHVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 10473 - protein, 1120 aa, Homo sapiens
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGALVDQAVFEELIRDHLPQLTEHMTDMTFFSSVSLSWFLTLFISVLPIESAVNVVDCFFYDGIKAILQLGLAILDYNLDKLLTCKDDAEAVTALNRFFDNVTNKDSPLPSNVQQGSNVSDEKTSHTRVDITDLIRESNEKYGNIRYEDIHSMRCRNRLYVIQTLEETTKQNVLRVVSQDVKLSLQELDELYVIFKKELFLSCYWCLGCPVLKHHDPSLPYLEQYQIDCQQFRALYHLLSPWAHSANKDSLALWTFRLLDENSDCLINFKEFSSAIDIMYNGSFTEKLKLLFKLHIPPAYTEVKSKDASKGDELSKEELLYFSQLHVSKPANEKEAESAKHSPEKGKGKIDIQAYLSQWQDELFKKEENIKDLPRMNQSQFIQFSKTLYNLFHEDPEEESLYQAIAVVTSLLLRMEEVGRKLHSPTSSAKGFSGTVCGSGGPSEEKTGSHLEKDPCSFREEPQWSFAFEQILASLLNEPALVRFFEKPIDVKAKLENARISQLRSRTKM

SEQ ID NO: 10474 - protein, 632 aa, Homo sapiens
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRLFDKETFDNDPVLYNPLQITKRGLENRAHSEQFNAFFRLPKGESLKEVHECFLWVPFSHFNTHGKMCISENYICFASQDGNQCSVIIPLREVLAIDKTNDSSKSVIISIKGKTAFRFHEVKDFEQLVAKLRLRCGAASTQYHDISTELAISSESTEPSDNFEVQSLTSQRECSKTVNTEALMTVFHPQNLETLNSKMLKEKMKEQSWKILFAECGRGVSMFRTKKTRDLVVRGIPETLRGELWMLFSGAVNDMATNPDYYTEVVEQSLGTCNLATEEIERDLRRSLPEHPAFQSDTGISALRRVLTAYAYRNPKIGYCQAMNILTSVLLLYAKEEEAFWLLVAVCERMLPDYFNRRIIGSDDFMPLVRIQGQCVIGEK

SEQ ID NO: 10475 - protein, 1858 aa, Homo sapiens
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 10476 - protein, 217 aa, Homo sapiens
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 10477 - protein, 196 aa, Homo sapiens [sequence omitted]

SEQ ID NO: 10478 - protein, 128 aa, Homo sapiens [sequence omitted]

SEQ ID NO: 10479 - protein, 157 aa, Homo sapiens [sequence omitted]

SEQ ID NO: 10480 - protein, 97 aa, Homo sapiens [sequence omitted]

SEQ ID NO: 10481 - protein, 70 aa, Homo sapiens [sequence omitted]

SEQ ID NO: 10482 - protein, 70 aa, Homo sapiens [sequence omitted]

SEQ ID NO: 10483 - protein, 51 aa, Homo sapiens [sequence omitted]

SEQ ID NO: 10484 - protein, 288 aa, Homo sapiens [sequence omitted]

SEQ ID NO: 10485 - protein, 288 aa, Homo sapiens [sequence omitted]

SEQ ID NO: 10486 - protein, 266 aa, Homo sapiens [sequence omitted]

SEQ ID NO: 10487 - protein, 317 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 10488 - protein, 317 aa, Homo sapiens; identical to SEQ ID NO: 10487

SEQ ID NO: 10489 - protein, 135 aa, Homo sapiens [sequence omitted]

SEQ ID NO: 10490 - protein, 293 aa, Homo sapiens [sequence omitted]

SEQ ID NO: 10491 - protein, 263 aa, Homo sapiens [sequence omitted]

SEQ ID NO: 10492 - protein, 977 aa, Homo sapiens
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEGRNTDVAQSPEAPKQEAPAKKKSGSKKKGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLHSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLMAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 10493 - protein, 243 aa, Homo sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTIPCPTIAESRRCKMTMRHCPGGKRTPKAKEKRNKKKKRKLIERAQEQHSVFLATDRANQ

SEQ ID NO: 10494 - protein, 620 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQRLRQAERSRQSAELDNRLFKQDFGDKINSLQLEVEELTRQRNQLELELKQEKERRLQNDRSIPGRGSQKSESKMDGKHKMQEENVKLKKPLEESHRLQPHPMDEQDQLLLSEKPQLCQLCQEDGSLTKNVCKNCSGTFCDACSTNELPLPSSIKLERVCNPCHKHLMKQYSTSPS

SEQ ID NO: 10495 - protein, 469 aa, Homo sapiens
MSALTPPTDMPTPTTDKITQAAMETIYLCKFRVSMDGEWLCLRELDDISLTPDPEPTHEDPNYLMANERMNLMNMAKLSIKGLIESALNLGRTLDSDYAPLQQFFVVMEHCLKHGLKAKKTFLGQNKSFWGPLELVEKLVPEAAEITASVKDLPGLKTPVGRGRAWLRLALMQKKLSEYMKALINKKELLSEFYEPNALMMEEEGAIIAGLLVGLNVIDANFCMKGEDLDSQVGVIDFSMYLKDGNSSKGTEGDGQITAILDQKNYVEELNRHLNATVNNLQAKVDALEKSNTKLTEELAVANNRIITLQEEMERVKEESSYILESNRKGPKQDRTAEGQALSEARKHLKEETQLRLDVEKELEMQISMRQEMELAMKMLEKDVCEKQDALVSLRQQLDDLRALKHELAFKLQSSDLGVKQKSELNSRLEEKTNQMAATIKQLEQSEKDLVKQAKTLNSAANKLIPKHH

SEQ ID NO: 10496 - protein, 1265 aa, Homo sapiens
  VARIANT 494: Xaa = Any Amino Acid
MDVLAWWSLDGPQDSGKRSWSCDRPQTSKRQGEEGEGKQVSKHPKQPERPCGEQCSPFGAPIPRSPWSPWTSSPPVTFAFQVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPVRGYLGPRSCTEGLTPGYRGKGLSGSRLPIHSSIYALTHAHIHPPNTHSSIHLYLHAPILTSIHPPIVISIHPPILTEPNNISYLSLYTKCLVVPDPGAQELRQKNHLNPGSRRCSEPRSRRCPPALATERDSISKKKKKKKKKDNLDFLCETRQGSHVTVHHGQTXVLLSLQRDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 10497 - protein, 1265 aa, Homo sapiens; identical to SEQ ID NO: 10496
  VARIANT 494: Xaa = Any Amino Acid

SEQ ID NO: 10498 - protein, 90 aa, Homo sapiens
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 10499 - protein, 915 aa, Homo sapiens
MAETLSGLGDSGAAGAAALSSASSETGTRRLSDLRVIDLRAELRKRNVDSSGNKSVLMERLKKAIEDEGGNPDEIEITSEGNKKTSKRSSKGRKPEEEGVEDNGLEENSGDGQEDVETSLENLQDIDIMDISVLDEAEIDNGSVADCVEDDDADNLQESLSDSRELVEGEMKELPEQLQEHAIEDKETINNLDTSSSDFTILQEIEEPSLEPENEKILDILGETCKSEPVKEESSELEQPFAQDTSSVGPDRKLAEEEDLFDSAHPEEGDLDLASESTAHAQSSKADSLLAVVKREPAEQPGDGERTDCEPVGLEPAVEQSSAASELAEASSEELAEAPTEAPSPEARDSKEDGRKFDFDACNEVPPAPKESSTSEGADQKMSSPEDDSDTKRLSKEEKGRSSCGRNFWVSGLSSTTRATDLKNLFSKYGKVVGAKVVTNARSPGARCYGFVTMSTAEEATKCINHLHKTELHGKMISVEKAKNEPVGKKTSDKRDSDGKKEKSSNSDRSTNLKRDDKCDRKDDAKKGDDGSGEKSKDQDDQKPGPSERSRATKSGSRGTERTVVMDKSKGVPVISVKTSGSKERASKSQDRKSASREKRSVVSFDKVKEPRKSRDSESHSRVRERSEREQRMQAQWEREERERLEIARERLAFQRQRLERERMERERLERERMHVEHERRREQERIHREREELRRQQELRYEQERRPAVRRPYDLDRRDDAYWPEAKRAALDERYHSDFNRQDRFHDFDHRDRGRYPDHSVDRREGSRSMMGEREGQHYPERHGGPERHGRDSRDGWGGYGSDKRMSEGRGLPPPPRRDWGDHGRREDDRSWQGTADGGMMDRDHKRWQGGERSMSGHSGPGHMMNRGGMSGRGSFAPGGASRGHPIPHGGMQGGFGGQSRGSRPSDARFTRRY

SEQ ID NO: 10500 - protein, 690 aa, Homo sapiens
MGAVARAHGGLRVARARESVAGGRHRGAGRPGARAAGAAAGLVRAEAGGRRAGRGRRPGRGLPTGGGGLAAAAVGREVAQGLCDAIRLDGGLDLLLRLLQAPELETRVQAARLLEQILVAENRDRVARIGLGVILNLAKEREPVELARSVAGILEHMFKHSEETCQRLVAAGGLDAVLYWCRRTDPALLRHCALALGNCALHGGQAVQRRMVEKRAAEWLFPLAFSKEDELLRLHACLAVAVLATNKEVEREVERSGTLALVEPLVASLDPGRFARCLVDASDTSQGRGPDDLQRLVPLLDSNRLEAQCIGAFYLCAEAAIKSLQGKTKVFSDIGAIQSLKRLVSYSTNGTKSALAKRALRLLGEEVPRPILPSVPSWKEAEVQTWLQQIGFSKYCESFREQQVDGDLLLRLTEEELQTDLGMKSGITRKRFFRELTELKTFANYSTCDRSNLADWLGSLDPRFRQYTYGLVSCGLDRSLLHRVSEQQLLEDCGIHLGVHRARILTAAREMLHSPLPCTGGKPSGDTPDVFISYRRNSGSQLASLLKVHLQLHGFSVFIDVEKLEAGKFEDKLIQSVMGARNFVLVLSPGALDKCMQDHDCKDWVHKEIVTALSCGKNIVPIIDGFEWPEPQVLPEDMQAVLTFNGIKWSHEYQEATIEKIIRFLQGRSSRDSSAGSDTSLEGAAPMGPT

SEQ ID NO: 10501 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 10502 - protein, 250 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQALEVIKQLKEKMKIERAHMRLRFILPVNEGKKLKEKLKPLIKVIESEDYGQQLEIVCLIDPGCFREIDELIKKETKGKGSLEVLNLKDVEEGDEKFE

SEQ ID NO: 10503 - protein, 424 aa, Homo sapiens
MSVGCPEPEPPRSLTCCGPGTAPGPGAGVPLLTEDMQALTLRTLAASDVTKHYELVRELGKGTYGKVDLVVYKGTGTKMALKFVNKSKTKLKNFLREVSITNSLSSSPFIIKVFDVVFETEDCYVFAQEYAPAGDLFDIIPPQVGLPEDTVKRCVQQLGLALDFMHGRQLVHRDIKPENVLLFDRECRRVKLADFGMTRRVGCRVKRVSGTIPYTAPEVCQAGRADGLAVDTGVDVWAFGVLIFCVLTGNFPWEAASGADAFFEEFVRWQRGRLPGLPSQWRRFTEPALRMFQRLLALEPERRGPAKEVFRFLKHELTSELRRRPSHRARKPPGDRPPAAGPLRLEAPGPLKRTVLTESGSGSRPAPPAVGSVPLPVPVPVPVPVPVPVPEPGLAPQGPPGRTDGRADKSKGQVVLATAIEICV

SEQ ID NO: 10504 - protein, 684 aa, Homo sapiens
MSASGVLSFTQQGWEQVLAKVKRAVVYLDAACAESLHWGCGSTRLLEAVGGPDCHLREFEPDAIGGGAKQPKAVFVLSCLLKGRTVEILRDIICRSHFQYCVVVTTVSHAVHLTANHVPAAAAAEMEGQQPVFEQLEEKLCEWMGNMNYTAEVFHVPLLLAPVAPHFALTPAFASLFPLLPQDVHLLNSARPDKRKLGSLGDVDSTTLTPELLLQIRCLVSGLSSLCEHLGVREECFAVGSLSQVIAADLANYAPAKNRKKTAAGRASVVFVDRTLDLTGAVGHHGDNLVEKIISALPQLPGHTNDVMVNMIALTALHTEEENYNVVAPGCLSQSSDTTAKALWEALLNTKHKEAVMEVRRHLVEAASRENLPIKMSMGRVTPGQLMSYIQLFKNNLKALMNHCGLLQLGLATAQTLKHPQTAKWDNFLAFERLLLQSIGESAMSVVLNQLLPMIKPVTQRTNEDYSPEELLILLIYIYSVTGELTVDKDLCEAEEKVKKALAQVFCEESGLSPLLQKITDWDSSINLTFHKSKIAVDELFTSLRDIAGARSLLKQFKSVYVPGNHTHQASYKPLLKQVVEEIFHPERPDSVDIEHMSSGLTDLLKTGFSMFMKVSRPHPSDYPLLILFVVGGVTVSEVKMVKDLVASLKPGTQVIVLSTRLLKPLNIPELLFATDRLHPDLGF

SEQ ID NO: 10505 - protein, 1998 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTTEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 10506 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGVGGLGELLESSSEASKLSSKGAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDGESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDFKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYSVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDRGDPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLCESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTPPPSYDSVTKPDKEKFEKDKPEKESKGKEVRENQK

SEQ ID NO: 10507 - protein, 322 aa, Homo sapiens
MSSSPWEPATLRRVFVVGVGMTKFVKPGAENSRDYPDLAEEAGKKALADAQIPYSAVDQACVGYVFGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGGHSCS

SEQ ID NO: 10508 - protein, 143 aa, Homo sapiens
MGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 10509 - protein, 140 aa, Homo sapiens
MGFPEAARTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 10510 - protein, 59 aa, Homo sapiens
MGFPEAASSFRTHQIEAVPTSSASDGFKANLVFKEIEKKLEEIRRLTAQSQWLTQTSWL

SEQ ID NO: 10511 - protein, 547 aa, Homo sapiens
MSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 10512 - protein, 765 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 10513 - protein, 1094 aa, Homo sapiens
MNVNQSVPPVPPFGQPQPIYPGYHQSSYGGQSGSTAPAIPYGAYNGPVPGYQQTPPQGMSRAPPSSGAPPASTAQAPCGQAAYGQFGQGDVQNGPSSTVQMQRLPGSQPFGSPLAPVGNQPPVLQPYGPPPTSAQVATQLSGMQISGAVAPAPPSSGLGFGPPTSLASASGSFPNSGLYGSYPQGQAPPLSQAQGHPGIQTPQRSAPSQASSFTPPASGGPRLPSMTGPLLPGQSFGGPSVSQPNHVSSPPQALPPGTQMTGPLGPLPPMHSPQQPGYQPQQNGSFGPARGPQSNYGGPYPAAPTFGSQPGPPQPLPPKRLDPDAIPSPIQVIEDDRNNRGTEPFVTGVRGQVPPLVTTNFLVKDQGNASPRYIRCTSYNIPCTSDMAKQAQVPLAAVIKPLARLPPEEASPYVVDHGESGPLRCNRCKAYMCPFMQFIEGGRRFQCCFCSCINDVPPQYFQHLDHTGKRVDAYDRPELSLGSYEFLATVDYCKNNKFPSPPAFIFMIDVSYNAIRTGLVRLLCEELKSLLDFLPREGGAEESAIRVGFVTYNKVLHFYNVKSSLAQPQMMVVSDVADMFVPLLDGFLVNVNESRAVITSLLDQIPEMFADTRETETVFVPVIQAGMEALKAAECAGKLFLFHTSLPIAEAPGKLKNRDDRKLINTDKEKTLFQPQTGAYQTLAKECVAQGCCVDLFLFPNQYVDVATLSVVPQLTGGSVYKYASFQVENDQERFLSDLRRDVQKVVGFDAVMRVRTSTGIRAVDFFGAFYMSNTTDVELAGLDGDKTVTVEFKHDDRLNEESGALLQCALLYTSCAGQRRLRIHNLALNCCTQLADLYRNCETDTLINYMAKFAYRGVLNSPVKAVRDTLITQCAQILACYRKNCASPSSAGQLILPECMKLLPVYLNCVLKSDVLQPGAEVTTDDRAYVRQLVTSMDVTETNVFFYPRLLPLTKSPVESTTEPPAVRASEERLSNGDIYLLENGLNLFLWVGASVQQGVVQSLFSVSSFSQITSGLSVLPVLDNPLSKKVRGLIDSLRAQRSRYMKLTVVKQEDKMEMLFKHFLVEDKSLSGGASYVDFLCHMHKEIRQLLS

SEQ ID NO: 10514 - protein, 1094 aa, Homo sapiens; identical to SEQ ID NO: 10513

SEQ ID NO: 10515 - protein, 453 aa, Homo sapiens
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVWVKISSSWIGIVLYVWTLVAPLVLTNRDFD

SEQ ID NO: 10516 - protein, 66 aa, Homo sapiens
MVAKQRIRMANEKHSKNITQRGNVAKTSRNAPEEKASVGPWLLALFIFVVCGSAIFQIIQSIRMGM

SEQ ID NO: 10517 - protein, 491 aa, Homo sapiens
MALLWGLLVLSWSCLQGPCSVFSPVSAMEPLGWQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 10518 - protein, 314 aa, Homo sapiens
MLGKGGKRKFDEHEDGLEGKIVSPCDGPSKVSYTLQRQTIFNISLMKLYNHRPLTEPSLQKTVLINNMLRRIQEELKQEGSLRPMFTPSSQPTTEPSDSYREAPPAFSHLASPSSHPCDLGSTTPLEACLTPASLLEDDDDTFCTSQAMQPTAPTKLSPPALLPEKDSFSSALDEIEELCPTSTSTEAATAATDSVKGTSSEAGTQKLDGPQESRADDSKLMDSLPGNFEITTSTGFLTDLTLDDILFADIDTSMYDFDPCTSSSGTASKMAPVSADDLLKTLAPYSSQPVTPSQPFKMDLTELDHIMEVLVGS

SEQ ID NO: 10519 - protein, 356 aa, Homo sapiens
MTLVLSMNRFCEPIVSEGAAEIAGYQTLWEADSYGGPSPPGPAQAPLQGDRGAGPPLAGSHYRGISNPITTSKITYFKRKYVEEEDFHPPLSSCSHKTISIFEERAHILYMSLEKLKFIDDPEVYLRRSVLINNLMKRIHGEIIMQNNWCFPACSFNGTSAQEWFMAQDCPYRKRPRMAKEECEKFHACCFYQECGGHYLNLPLSVNANVGSASTAASSPSASSSSSSSSSSPPLPLPSCSRQVDFDVGSASIYKSDGQIPANEIFVTNVRSLGVQEKAKLNDEKANDDTNRDGGPLSHEPVGNDLAFECKGQFYDYFETGYNERNNVNESWKKSLRKKEASPPSNKLCCSKGSKI

SEQ ID NO: 10520 - protein, 1455 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKAFREGSRKSLRMKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10521 - protein, 1442 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10522 - protein, 1331 aa, Homo sapiens
MSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10523 - protein, 908 aa, Homo sapiens
MCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQICD

SEQ ID NO: 10524 - protein, 705 aa, Homo sapiens [sequence omitted]

SEQ ID NO: 10525 - protein, 924 aa, Homo sapiens
MHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10526 - protein, 1166 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRW

SEQ ID NO: 10527 - protein, 1242 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQVR

SEQ ID NO: 10528 - protein, 1461 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFENISSPESSPAHRPESLSPELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10529 - protein, 992 aa, Homo sapiens
MEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10530 - protein, 1080 aa, Homo sapiens [sequence omitted]

SEQ ID NO: 10531 - protein, 1455 aa, Homo sapiens; identical to SEQ ID NO: 10520

SEQ ID NO: 10532 - protein, 1331 aa, Homo sapiens; identical to SEQ ID NO: 10522

SEQ ID NO: 10533 - protein, 1344 aa, Homo sapiens
MSRGKVIRLHRRKQDNISGGDSSATESWDEELSPSTVLYTATQHTPTSITLTVRRTKPKKRKKSPEKGRAAPKTKKIKAFREGSRKSLRMKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 10534 - protein, 1442 aa, Homo sapiens; identical to SEQ ID NO: 10521

SEQ ID NO: 10535 - protein, 1331 aa, Homo sapiens; identical to SEQ ID NO: 10522

SEQ ID NO: 10536 - protein, 1455 aa, Homo sapiens; identical to SEQ ID NO: 10520

SEQ ID NO: 10537 - protein, 908 aa, Homo sapiens; identical to SEQ ID NO: 10523

SEQ ID NO: 10538 - protein, 705 aa, Homo sapiens [sequence omitted]

SEQ ID NO: 10539 - protein, 924 aa, Homo sapiens; identical to SEQ ID NO: 10525

SEQ ID NO: 10540 - protein, 1166 aa, Homo sapiens; identical to SEQ ID NO: 10526

SEQ ID NO: 10541 - protein, 1242 aa, Homo sapiens; identical to SEQ ID NO: 10527

SEQ ID NO: 10542 - protein, 1461 aa, Homo sapiens; identical to SEQ ID NO: 10528

SEQ ID NO: 10543 - protein, 992 aa, Homo sapiens; identical to SEQ ID NO: 10529

SEQ ID NO: 10544 - protein, 1080 aa, Homo sapiens [sequence omitted]

SEQ ID NO: 10545 - protein, 1455 aa, Homo sapiens; identical to SEQ ID NO: 10520

SEQ ID NO: 10546 - protein, 1331 aa, Homo sapiens; identical to SEQ ID NO: 10522

SEQ ID NO: 10547 - protein, 1344 aa, Homo sapiens; identical to SEQ ID NO: 10533

SEQ ID NO: 10548 - protein, 366 aa, Homo sapiens
MDSDDEMVEEAVEGHLDDDGLPHGFCTVTYSSTDRFEGNFVHGEKNGRGKFFFFDGSTLEGYYVDDALQGQGVYTYEDGGVLQGTYVDGELNGPAQEYDTDGRLIFKGQYKDNIRHGVCWIYYPDGGSLVGEVNEDGEMTGEKIAYVYPDERTALYGKFIDGEMIEGKLATLMSTEEGRPHFELMPGNSVYHFDKSTSSCISTNALLPDPYESERVYVAESLISSAGEGLFSKVAVGPNTVMSFYNGVRITHQEVDSRDWALNGNTLSLDEETVIDVPEPYNHVSKYCASLGHKANHSFTPNCIYDMFVHPRFGPIKCIRTLRAVEADEELTVAYGYDHSPPGKSGPEAPEWYQVELKAFQATQQK

SEQ ID NO: 10549 - protein, 1304 aa, Homo sapiens
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 10550 - protein, 295 aa, Homo sapiens
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 10551 - protein, 508 aa, Homo sapiens
MTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 10552 - protein, 1082 aa, Homo sapiens
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPSISDDSYFRKECGRDLEFSHSDSRDQVIGHRKLGHFRSQDWKFALRGSWEQDFGHPVSQESSWSQEYSFGPSAVLGDFGSSRLIEKECLEKESRDYDVDHPGEADSVLRGSSQVQARGRALNIVDQEGSLLGKGETQGLLTAKGGVGKLVTLRNVSTKKIPTVNRITPKTQGTNQIQKNTPSPDVTLGTNPGTEDIQFPIQKIPLGLDLKNLRLPRRKMSFDIIDKSDVFSRFGIEIIKWAGFHTIKDDIKFSQLFQTLFELETETCAKMLASFKCSLKPEHRDFCFFTIKFLKHSALKTPRVDNEFLNMLLDKGAVKTKNCFFEIIKPFDKYIMRLQDRLLKSVTPLLMACNAYELSVKMKTLSNPLDLALALETTNSLCRKSLALLGQTFSLASSFRQEKILEAVGLQDIAPSPAAFPNFEDSTLFGREYIDHLKAWLVSSGCPLQVKKAEPEPMREEEKMIPPTKPEIQAKAPSSLSDAVPQRADHRVVGTIDQLVKRVIEGSLSPKERTLLKEDPAYWFLSDENSLEYKYYKLKLAEMQRMSENLRGADQKPTSADCAVRAMLYSRAVRNLKKKLLPWQRRGLLRAQGLRGWKARRATTGTQTLLSSGTRLKHHGRQAPGLSQAKPSLPDRNDAAKDCPPDPVGPSPQDPSLEASGPSPKPAGVDISEAPQTSSPCPSADIDMKTMETAEKLARFVAQVGPEIEQFSIENSTDNPDLWFLHDQNSSAFKFYRKKVFELCPSICFTSSPHNLHTGGGDTTGSQESPVDLMEGEAEFEDEPPPREAELESPEVMPEEEDEDDEDGGEEAPAPGGAGKSEGSTPADGLPGEAAEDDLAGAPALSQASSGTCFPRKRISSKSLKVGMIPAPKRVCLIQEPKVHEPVRIAYDRPRGRPMSKKKKPKDLDFAQQKLTDKNLGFQMLQKMGWKEGHGLGSLGKGIREPVSVGTPSEGEGLGADGQEHKEDTFDVFRQRMMQMYRHKRANK

SEQ ID NO: 10553 - protein, 1082 aa, Homo sapiens; identical to SEQ ID NO: 10552

SEQ ID NO: 10554 - protein, 238 aa, Homo sapiens
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSISLRRSRSASLRRSRSGSIKGSRYFQSPSRSRSRSRSISRPRSSRSKSRSPSPKRSRSPSGSPRRSASPERMD

SEQ ID NO: 10555 - protein, 159 aa, Homo sapiens
MEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTWYSLSYIPYARDAVIKCCSSLLS

SEQ ID NO: 10556 - protein, 871 aa, Homo sapiens
MDGESEVDFSSNSITPLWRRRSIPQPHQLLGRSKPRPQSYQSPNGLLITDFPVEDGGTLSAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSRGKPPADRTSLTQVEIVRSFTAKQPDELSLQVADVVLIYQRVSDGWYEGERLRDGERGWFPMECAKEITCQATIDKNVERMGRLLGLETNV

SEQ ID NO: 10557 - protein, 828 aa, Homo sapiens
MMEGLKKRTRKAFGIRKKEKDTDSTGSPDRDGIQPSPHEPPYNSKAECAREGGKKVSKKSNGAPNGFYAEIDWERYNSPELDEEGYSIRPEEPGSTKGKHFYSSSESEEEEESHKKFNIKIKPLQSKDILRNAATVDELKASIGNIALSPSPVRKSPRRSPGAIKRNLSSEEVARPRRSTPTPELISKKPPDDTTALAPLFGPPLESAFDEQKTEVLLDQPEIWGSGQPINPSMESPKLTRPFPTGTPPPLPPKNVPATPPRTGSPLTIGPGNDQSATEVKIEKLPSINDLDSIFGPVLSPKSVAVNAEEKWVHFSDTSPEHVTPELTPREKVVSPPATPDNPADSPAPGPLGPPGPTGPPGPPGPPRNVLSPLNLEEVQKKVAEQTFIKDDYLETISSPKDFGLGQRATPPPPPPPTYRTVVSSPGPGSGPGPGTTSGASSPARPATPLVPCRSTTPPPPPPRPPSRPKLPPGKPGVGDVSRPFSPPIHSSSPPPIAPLARAESTSSISSTNSLSAATTPTVENEQPSLVWFDRGKFYLTFEGSSRGPSPLTMGAQDTLPVAAAFTETVNAYFKGADPSKCIVKITGEMVLSFPAGITRHFANNPSPAALTFRVINFSRLEHVLPNPQLLCCDNTQNDANTKEFWVNMPNLMTHLKKVSEQKPQATYYNVDMLKYQVSAQGIQSTPLNLAVNWRCEPSSTDLRIDYKYNTDAMTTAVALNNVQFLVPIDGGVTKLQAVLPPAVWNAEQQRILWKIPDISQKSENGGVGSLLARFQLSEGPSKPSPLVVQFTSEGSTLSGCDIELVGAGYRFSLIKKRFAAGKYLADN

SEQ ID NO: 10558 - protein, 504 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 10559 - protein, 398 aa, Homo sapiens
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLNFSISISNITPADAGTYYCVKFRKGSPDDVEFKSGAGTELSVRAKPSAPVVSGPAVRATPEHTVSFTCESHGFSPRDITLKWFKNGNELSDFQTNVDPAGDSVSYSIHSTARVVLTRGDVHSQVICEMAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHEPALAPTAPLLVALLLGPKLLLVVGVSAIYICWKQKA

SEQ ID NO: 10560 - protein, 276 aa, Homo sapiens
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 10561 - protein, 920 aa, Homo sapiens
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFVNNPLSGLIIFIGLLIQNPWWTITGGLGTVVSTLTALALGQDRSAIASGLHGYNGMLVGLLMAAFSEKLDYYWWLLFPVTFTAMSCPVLSSALNSIFSKWDLPVFTLPFNIAVTLYLAATGHYNLFFPTTLVEPVSSVPNITWTEMEMPLLLQAIPVGVGQVYGCDNPWTGGVFLVALFISSPLICLHAAIGSIVGLLAALSVATPFETIYTGLWSYNCVLSCIAIGGMFYALTWQTHLLALICALFCAYMEAAISNIMSVVGVPPGTWAFCLATIIFLLLTTNNPAIFRLPLSKVTYPEANRIYYLTVKSGEEEKAPSGGGGEHPPTAGPKVEEGSEAVLSKHRSVFHIEWSSIRRRSKVFGKGEHQERQNKDPFPYQYRKPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTALLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 10562 - protein, 510 aa, Homo sapiens
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGWIYDITQKYDFSFYICGLLYMIGILFLLIQPCIRIIEQSRRKYMDGAHV

SEQ ID NO: 10563 - protein, 487 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 10564 - protein, 652 aa, Homo sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 10565 - protein, 551 aa, Homo sapiens
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 10566 - protein, 274 aa, Homo sapiens
MDRPGFVAALVAGGVAGVSVDLILFPLDTIKTRLQSPQGFNKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 10567 - protein, 66 aa, Homo sapiens
MKHMLAASAGEVVACLIRVPSEVVKQRAQVSASTRTFQIFSNILYEEGIQGLYRGYKSTVLREEED

SEQ ID NO: 10568 - protein, 186 aa, Homo sapiens
MKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 10569 - protein, 337 aa, Homo sapiens
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGSDLAFNLEGYIFVFLNDIFTSANGVYTKQKMDPKELGKYGVLFYNACFMIIPTLIISVSTGDLQQATEFNQWKNVVFILQFLLSCFLGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 10570 - protein, 266 aa, Homo sapiens
MPIWVVLLSRIIMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 10571 - protein, 335 aa, Homo sapiens
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 10572 - protein, 314 aa, Homo sapiens
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 10573 - protein, 490 aa, Homo sapiens
MEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQHWEVFRKVTEVFILVPALLGLKGNLEMTLASRLSTAVNIGKMDSPIEKWNLIIGNLALKQVQATVVGFLAAVAAIILGWIPEGKYYLDHSILLCSSSVATAFIASLLQGIIMVGVIVGSKKTGINPDNVATPIAASFGDLITLAILAWISQGLYSCLETYYYISPLVGVFFLALTPIWIIIAAKHPATRTVLHSGWEPVITAMVISSIGGLILDTTVSDPNLVGIVVYTPVINGIGGNLVAIQASRISTYLHLHSIPGELPDEPKGCYYPFRTFFGPGVNNKSAQVLLLLVIPGHLIFLYTIHLMKSGHTSLTIIFIVVYLFGAVLQVFTLLWIADWMVHHFWRKGKDPDSFSIPYLTALGDLLGTALLALSFHFLWLIGDRDGDVGD

SEQ ID NO: 10574 - protein, 1088 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILLGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVSPMMVLSLVFVRKLMDLLFTKRELCWLDDLMPESKKKKLEYAEKEEEQCVLPMEDEGTVQLPLEGHYRDDPSVINISDEMSKTALWRNLLITADNSKDKESSFPSKSSPS

SEQ ID NO: 10575 - protein, 635 aa, Homo sapiens
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGFSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 10576 - protein, 580 aa, Homo sapiens
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 10577 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 10578 - protein, 581 aa, Homo sapiens
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 10579 - protein, 958 aa, Homo sapiens
MHTCCPPVTLEQDLHRKMHSWMLQTLAFAVTSLVLSCAETIDYYGEICDNACPCEEKDGILTVSCENRGIISLSEISPPRFPIYHLLLSGNLLNRLYPNEFVNYTGASILHLGSNVIQDIETGAFHGLRGLRRLHLNNNKLELLRDDTFLGLENLEYLQVDYNYISVIEPNAFGKLHLLQVLILNDNLLSSLPNNLFRFVPLTHLDLRGNRLKLLPYVGLLQHMDKVVELQLEENPWNCSCELISLKDWLDSISYSALVGDVVCETPFRLHGRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLSVLILSLLLVFIMSVFVAAGLFVLVMKRRKKNQSDHTSTNNSDVSSFNMQYSVYGGGGGTGGHPHAHVHHRGPALPKVKTPAGHVYEYIPHPLGHMCKNPIYRSREGNSVEDYKDLHELKVTYSSNHHLQQQQQPPPPPQQPQQQPPPQLQLQPGEEERRESHHLRSPAYSVSTIEPREDLLSPVQDADRFYRGILEPDKHCSTTPAGNSLPEYPKFPCSPAAYTFSPNYDLRRPHQYLHPGAGDSRLREPVLYSPPSAVFVEPNRNEYLELKAKLNVEPDYLEVLEKQTTFSQF

SEQ ID NO: 10580 - protein, 183 aa, Homo sapiens
MSAARESHPHGVKRSASPDDDLGSSNWEAADLGNEERKQKFLRLMGAGKKEHTGRLVIGDHKSTSHFRTGEEDKKINEELESQYQQSMDSKLSGRYRRHCGLGFSEVEDHDGEGDVAGDDDDDDDDSPDPESPDDSESDSESEKEESAEELQAAEHPDEVEDPKNKKDAKSNYKMMFVKSSGS

SEQ ID NO: 10581 - protein, 1647 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 10582 - protein, 1105 aa, Homo sapiens
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAGGEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 10583 - protein, 366 aa, Homo sapiens
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 10584 - protein, 513 aa, Homo sapiens
MSIEIESSDVIRLIMQYLKENSLHRALATLQEETTVSLNTVDSIESFVADINSGHWDTVLQAIQSLKLPDKTLIDLYEQVVLELIELRELGAARSLLRQTDPMIMLKQTQPERYIHLENLLARSYFDPREAYPDGSSKEKRRAAIAQALAGEVSVVPPSRLMALLGQALKWQQHQGLLPPGMTIDLFRGKAAVKDVEEEKFPTQLSRHIKFGQKSHVECARFSPDGQYLVTGSVDGFIEVWNFTTGKIRKDLKYQAQDNFMMMDDAVLCMCFSRDTEMLATGAQDGKIKVWKIQSGQCLRRFERAHSKGVTCLSFSKDSSQILSASFDQTIRIHGLKSGKTLKEFRGHSSFVNEATFTQDGHYIISASSDGTVKIWNMKTTECSNTFKSLGSTAGTDITVNSVILLPKNPEHFVVCNRSNTVVIMNMQGQIVRSFSSGKREGGDFVCCALSPRGEWIYCVGEDFVLYCFSTVTGKLERTLTVHEKDVIGIAHHPHQNPIATYSEDGLLKLWKP

SEQ ID NO: 10585 - protein, 748 aa, Homo sapiens
MSNPGGRRNGPVKLRLTVLCAKNLVKKDFFRLPDPFAKVVVDGSGQCHSTDTVKNTLDPKWNQHYDLYIGKSDSVTISVWNHKKIHKKQGAGFLGCVRLLSNAINRLKDTGYQRLDLCKLGPNDNDTVRGQIVVSLQSRDRIGTGGQVVDCSRLFDNDLPDGWEERRTASGRIQYLNHITRTTQWERPTRPASEYSSPGRPLSCFVDENTPISGTNGATCGQSSDPRLAERRVRSQRHRNYMSRTHLHTPPDLPEGYEQRTTQQGQVYFLHTQTGVSTWHDPRVPRDLSNINCEELGPLPPGWEIRNTATGRVYFVDHNNRTTQFTDPRLSANLHLVLNRQNQLKDQQQQQVVSLCPDDTECLTVPRYKRDLVQKLKILRQELSQQQPQAGHCRIEVSREEIFEESYRQVMKMRPKDLWKRLMIKFRGEEGLDYGGVAREWLYLLSHEMLNPYYGLFQYSRDDIYTLQINPDSAVNPEHLSYFHFVGRIMGMAVFHGHYIDGGFTLPFYKQLLGKSITLDDMELVDPDLHNSLVWILENDITGVLDHTFCVEHNAYGEIIQHELKPNGKSIPVNEENKKEYVRLYVNWRFLRGIEAQFLALQKGFNEVIPQHLLKTFDEKELELIICGLGKIDVNDWKVNTRLKHCTPDSNIVKWFWKAVEFFDEERRARLLQFVTGSSRVPLQGFKALQGAAGPRLFTIHQIDACTNNLPKAHTCFNRIDIPPYESYEKLYEKLLTAIEETCGFAVE

SEQ ID NO: 10586 - protein, 433 aa, Homo sapiens
MRAEGLGGLERFCSPGKGRGLRALQPFQVGDLLFSCPAYAYVLTVNERGNHCEYCFTRKEGLSKCGRCKQAFYCNVECQKEDWPMHKLECSPMVVFGENWNPSETVRLTARILAKQKIHPERTPSEKLLAVKEFESHLDKLDNEKKDLIQSDIAALHHFYSKHLEFPDNDSLVVLFAQVNCNGFTIEDEELSHLGSAIFPDVALMNHSCCPNVIVTYKGTLAEVRAVQEIKPGEEVFTSYIDLLYPTEDRNDRLRDSYFFTCECQECTTKDKDKAKVEIRKLSDPPKAEAIRDMVRYARNVIEEFRRAKHYKSPSELLEICELSQEKMSSVFEDSNVYMLHMMYQAMGVCLYMQDWEGALQYGQKIIKPYSKHYPLYSLNVASMWLKLGRLYMGLEHKAAGEKALKKAIAIMEVAHGKDHPYISEIKQEIESH

SEQ ID NO: 10587 - protein, 98 aa, Homo sapiens
MLSRLQELRKEEETLLRLKAALHDQLNRLKVEELALQSMISSRRGDEMLSSHTVPEQSHDMLVHVDNEASINQTTLELSTKSHVTEEEEEEEEEESDS

SEQ ID NO: 10588 - protein, 517 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKAVLWRYKFSQLKGSSDDGKSKIKFLFQNPDTKQIEAKELEFSNLFAVLHCIHSFFAAKVACLDPLFLGNQATASTAASSATTSKAKYTT

SEQ ID NO: 10589 - protein, 519 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 10590 - protein, 290 aa, Homo sapiens
MTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 10591 - protein, 418 aa, Homo sapiens
MRACAGPRLGAAMMEGLDDGPDFLSEEDRGLKAINVDLQSDAALQVDISDALSERDKVKFTVHTKSSLPNFKQNEFSVVRQHEEFIWLHDSFVENEDYAGYIIPPAPPRPDFDASREKLQKLGEGEGSMTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 10592 - protein, 1292 aa, Homo sapiens
MSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEEDNPYTPTYQFPASTPSPKSEDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQFSSHSKLITPAPSSLPHSRRALSPEMHAVTSEWISLTVGVPGRRSLALTPPLPPLPEASIYNTDHLALSPRASPSLSLSLPHLSWSDRPTPRSVASPLALPSPHKTYSLAPTSQASLHMNGDGGVHTPSSGIHQDSFLQLPLGSSDSVISQLSDAFSSQSKRQPWREESGQYERKAERGAGERGPGGPKISKKSCLKPSDVVRCLSTEQRLSDLNTPEESRPGKPLGSAFPGSEAEQTERHRGGEQAGRKAARRGGSQQPQAQQRRVTPDRSQTSQDLFSYQALYSYIPQNDDELELRDGDIVDVMEKCDDGWFVGTSRRTKQFGTFPGNYVKPLYL

SEQ ID NO: 10593 - protein, 1151 aa, Homo sapiens
MSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEETKSCSVMSPRLECSGTVIAHCSLKLLDSSNPPTSASQVAGTADDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQPWREESGQYERKAERGAGERGPGGPKISKKSCLKPSDVVRCLSTEQRLSDLNTPEESRPGKPLGSAFPGSEAEQTERHRGGEQAGRKAARRGGSQQPQAQQRRVTPDRSQTSQDLFSYQALYSYIPQNDDELELRDGDIVDVMEKCDDGWFVGTSRRTKQFGTFPGNYVKPLYL

SEQ ID NO: 10594 - protein, 905 aa, Homo sapiens
MSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQLSHHSLRAGPDLTESEKSYVQPQAQQRRVTPDRSQTSQDLFSYQALYSYIPQNDDELELRDGDIVDVMEKCDDGWFVGTSRRTKQFGTFPGNYVKPLYL

SEQ ID NO: 10595 - protein, 740 aa, Homo sapiens
MSSECDGGSKAVMNGLAPGSNGQDKDMDPTKICTGKGAVTLRASSSYRETPSSSPASPQETRQHESKPDEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 10596 - protein, 684 aa, Homo sapiens
MSSECDGGSKAVMNGLAPGSNGQDKDMDPTKICTGKGAVTLRASSSYRETPSSSPASPQETRQHESKPDEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 10597 - protein, 816 aa, Homo sapiens
MSSECDGGSKAVMNGLAPGSNGQDKDMDPTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 10598 - protein, 781 aa, Homo sapiens
MSSECDGGSKAVMNGLAPGSNGQDKATADPLRARSISAVKIIPVKTVKNASGLVLPTDMDPTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 10599 - protein, 879 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 10600 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 10601 - protein, 335 aa, Homo sapiens
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 10602 - protein, 489 aa, Homo sapiens
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGASLDQLPSQGTMRKLRGKTPACSCLTEPTGSRRAMEGHSLCWGCLLH

SEQ ID NO: 10603 - protein, 520 aa, Homo sapiens
MGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 10604 - protein, 2472 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQNLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDFLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGVTIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLTQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGNEDAVKARLAALADQWQFLVQKSAEKSQKLKEANKQQNFNTGIKDIAFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETAFTVHKDRVNDVCTNGQDLIKKNNHHEENISSKMKGLNGKVSDLEKAAAQRKANVDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQDGKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPIVDGKGRELPTAFDYVEFTRSLFVN

SEQ ID NO: 10605 - protein, 2137 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 10606 - protein, 2328 aa, Homo sapiens
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 10607 - protein, 1085 aa, Homo sapiens
MGAAEAARTAFPSIERQVTIDYSALQAPLAGFTEIRSFGARLARAAAAAEGGAKLKMADKTPGGSQKASSKTRSSDVHSSGSSDAHMDASGPSDSDMPSRTRPKSPRKHNYRNESARESLCDSPHQNLSRPLLENKLKAFSIGKMSTAKRTLSKKEQEELKKKEDEKAAAEIYEEFLAAFEGSDGNKVKTFVRGGVVNAAKEEHETDEKRGKIYKPSSRFADQKNPPNQSSNERPPSLLVIETKKPPLKKGEKEKKKSNLELFKEELKQIQEERDERHKTKGRLSRFEPPQSDSDGQRRSMDAPSRRNRSSGVLDDYAPGSHDVGDPSTTNLYLGNINPQMNEEMLCQEFGRFGPLASVKIMWPRTDEERARERNCGFVAFMNRRDAERALKNLNGKMIMSFEMKLGWGKAVPIPPHPIYIPPSMMEHTLPPPPSGLPFNAQPRERLKNPNAPMLPPPKNKEDFEKTLSQAIVKVVIPTERNLLALIHRMIEFVVREGPMFEAMIMNREINNPMFRFLFENQTPAHVYYRWKLYSILQGDSPTKWRTEDFRMFKNGSFWRPPPLNPYLHGMSEEQETEAFVEEPSKKGALKEEQRDKLEEILRGLTPRKNDIGDAMVFCLNNAEAAEEIVDCITESLSILKTPLPKKIARLYLVSDVLYNSSAKVANASYYRKFFETKLCQIFSDLNATYRTIQGHLQSENFKQRVMTCFRAWEDWAIYPEPFLIKLQNIFLGLVNIIEEKETEDVPDDLDGAPIEEELDGAPLEDVDGIPIDATPIDDLDGVPIKSLDDDLDGVPLDATEDSKKNEPIFKVAPSKWEAVDESELEAQAVTTSKWELFDQHEESEEEENQNQEEESEDEEDTQSSKSEEHHLYSNPIKEEMTESKFSKYSEMSEEKRAKLREIELKVMKFQDELESGKRPKKPGQSFQEQVEHYRDKLLQREKEKELERERERDKKDKEKLESRSKDKKEKDECTPTRKERKRRHSTSPSPSRSSSGRRVKSPSPKSERSERSERSHKESSRSRSSHKDSPRDVSKKAKRSPSGSRTPKRSRRSRSRSPKKSGKKSRSQSRSPHRSHKKSKKNKH

SEQ ID NO: 10608 - protein, 1085 aa, Homo sapiens; identical to SEQ ID NO: 10607

SEQ ID NO: 10609 - protein, 237 aa, Homo sapiens
MTRCPAGQAEVEMAELYVKPGNKERGWNDPPQFSYGLQTQAGGPRRSLLTKRVAAPQDGSPRVPASETSPGPPPMGPPPPSSKAPRSPPVGSGPASGVEPTSFPVESEARLMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 10610 - protein, 536 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 10611 - protein, 536 aa, Homo sapiens; identical to SEQ ID NO: 10610

SEQ ID NO: 10612 - protein, 1177 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 10613 - protein, 1147 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 10614 - protein, 504 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 10615 - protein, 183 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 10616 - protein, 1231 aa, Homo sapiens
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNRRGTSLMEDDEEPIVEDVMMSSEGRIEDLNEGMDFDTMDIDLPPSKNRRERTELKPDFFDPASIMDESVLGVSMF

SEQ ID NO: 10617 - protein, 525 aa, Homo sapiens
MPLFTANPFEQDVEKATNEYNTTEDWSLIMDICDKVGSTPNGAKDCLKAIMKRVNHKVPHVALQALTLLGACVANCGKIFHLEVCSRDFATEVRAVIKNKAHPKVCEKLKSLMVEWSEEFQKDPQFSLISATIKSMKEEGITFPPAGSQTVSAAAKNGTSSNKNKEDEDIAKAIELSLQEQKQQHTETKSLYPSSEIQLNNKVARKVRALYDFEAVEDNELTFKHGEIIIVLDDSDANWWKGENHRGIGLFPSDFVTTNLNIETEVAAVDKLNVIDDDVEEIKKSEPEPVYIDEDKMDRALQVLQSIDPTDSKPDSQDLLDLEDICQQMGPMIDEKLEEIDRKHSELSELNVKVLEALELYNKLVNEAPVYSVYSKLHPPAHYPPASSGVPMQTYPVQSHGGNYMGQSIHQVTVAQSYSLGPDQIGPLRSLPPNVNSSVTAQPAQTSYLSTGQDTVSNPTYMNQNSNLQSATGTTAYTQQMGMSVDMSSYQNTTSNLPQLAGFPVTVPAHPVAQQHTNYHQQPLL

SEQ ID NO: 10618 - protein, 247 aa, Homo sapiens
MLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 10619 - protein, 179 aa, Homo sapiens
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 10620 - protein, 592 aa, Homo sapiens
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKGKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIGNESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRGAYEVSQAHKSCEVIIGSTHVLTPKKLLDDIKMLNKPKDKVSLIKDE

SEQ ID NO: 10621 - protein, 210 aa, Homo sapiens
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 10622 - protein, 313 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 10623 - protein, 484 aa, Homo sapiens
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 10624 - protein, 871 aa, Homo sapiens
MKYSCCALVLAVLGTELLGSLCSTVRSPRFRGRIQQERKNIRPNIILVPTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 10625 - protein, 95 aa, Homo sapiens
MANEKPTEEVKTENNNHINLKVAGQDGSVVQFKIKRQTPLSKLMKAYCEPRGLSVKQIRFRFGGQPISGTDKPAQLEMEDEDTIDVFQQPTGGVY

SEQ ID NO: 10626 - protein, 361 aa, Homo sapiens
MASLLAKDAYLQSLAKKICSHSAPEQQARTRAGKTQGSETAGPPKKKRKKTQKKFRKREEKAAEHKAKSLGEKSPAASGARRPEAAKEEAAWASSSAGNPADGLATEPESVFALDVLRQRLHEKIQEARGQGSAKELSPAALEKRRRRKQERDRKKRKRKELRAKEKARKAEEATEAQEVVEATPEGACTEPREPPGLIFNKVEVSEDEPASKAQRRKEKRQRVKGNLTPLTGRNYRQLLERLQARQSRLDELRGQDEGKAQELEAKMKWTNLLYKAEGVKIRDDERLLQEALKRKEKRRAQRQRRWEKRTAGVVEKMQQRQDRRRQNLRRKKAARAERRLLRARKKGRILPQDLERAGLV

SEQ ID NO: 10627 - protein, 151 aa, Homo sapiens
MAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKAMLLPKSLEQADAPTSQAGGMETQSQGAV

SEQ ID NO: 10628 - protein, 426 aa, Homo sapiens
MVLSVPVIALGATLGTATSILALCGVTCLCRHMHPKKGLLPRDQDPDLEKAKPSLLGSAQQFNVKKSTEPVQPRALLKFPDIYGPRPAVTAPEVINYADYSLRSTEEPTAPASPQPPNDSRLKRQVTEELFILPQNGVVEDVCVMETWNPEKAASWNQAPKLHYCLDYDCQKAELFVTRLEAVTSNHDGGCDCYVQGSVANRTGSVEAQTALKKRQLHTTWEEGLVLPLAEEELPTATLTLTLRTCDRFSRHSVAGELRLGLDGTSVPLGAAQWGELKTSAKEPSAGAGEVLLSISYLPAANRLLVVLIKAKNLHSNQSKELLGKDVSVKVTLKHQARKLKKKQTKRAKHKINPVWNEMIMFELPDDLLQASSVELEVLGQDDSGQSCALGHCSLGLHTSGSERSHWEEMLKNPRRQIAMWHQLHL

SEQ ID NO: 10629 - protein, 386 aa, Homo sapiens
  VARIANT 104, 154: Xaa = Any Amino Acid
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVXDKHELGRLQYSLDYDFQSGQLLVGILQAMGLAALDLGGSSDPYVRVYLLXDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 10630 - protein, 712 aa, Homo sapiens
MAQSSPQLDIQVLHDLRQRFPEIPEGVVSQCMLQNNNNLEACCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPRNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRGNFDPKAMNNFYDNIEPGPVVPPKPSKKDSSDPCTIERKARRISVTSKVQADIHDTQAAAADEHRTGSTQSPRTQPRDEDYEGAPWNCDSCTFLNHPALNRCEQCEMPRYT

SEQ ID NO: 10631 - protein, 1893 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGVSENGEGIILPSIIAPSSLASEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 10632 - protein, 1872 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 10633 - protein, 718 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 10634 - protein, 420 aa, Homo sapiens
MTMEKGMSSGEGLPSRSSQVSAGKITAKELETKQSYKEKRGGFVLVHAGAGYHSESKAKEYKHVCKRACQKAIEKLQAGALATDAVTAALVELEDSPFTNAGMGSNLNLLGEIECDASIMDGKSLNFGAVGALSGIKNPVSVANRLLCEGQKGKLSAGRIPPCFLVGEGAYRWAVDHGIPSCPPNIMTTRFSLAAFKRNKRKLELAERVDTDFMQLKKRRQSSEKENDSGTLDTVGAVVVDHEGNVAAAVSSGGLALKHPGRVGQAALYGCGCWAENTGAHNPYSTAVSTSGCGEHLVRTILARECSHALQAEDAHQALLETMQNKFISSPFLASEDGVLGGVIVLRSCRCSAEPDFSQNKQTLLVEFLWSHTTESMCVGYMSAQDGKAKTHISRLPPGAVAGQSVAIEGGVCRLESPVN

SEQ ID NO: 10635 - protein, 297 aa, Homo sapiens
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 10636 - protein, 1168 aa, Homo sapiens
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 10637 - protein, 648 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 10638 - protein, 108 aa, Homo sapiens
MADPRVRQIKIKTGVVKRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 10639 - protein, 1098 aa, Homo sapiens
MAERGGDGGESERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMSSMPPPPGMMFPPGMPPVTAPGTPALPPTEEIWVENKTPDGKVYYYNARTRESAWTKPDGVKVIQQSELTPMLAAQAQVQAQAQAQAQAQAQAQAQAQAQAQAQAQAQAQAQAQAQAQAQAQAQAQAQAQAQAQAQAQVQAQVQAQVQAQAVGASTPTTSSPAPAVSTSTSSSTPSSTTSTTTTATSVAQTVSTPTTQDQTPSSAVSVATPTVSVSTPAPTATPVQTVPQPHPQTLPPAVPHSVPQPTTAIPAFPPVMVPPFRVPLPGMPIPLPGVAMMQIVSCPYVKTVATTKTGVLPGMAPPIVPMIHPQVAIAASPATLAGATAVSEWTEYKTADGKTYYYNNRTLESTWEKPQELKEKEKLEEKIKEPIKEPSEEPLPMETEEEDPKEEPIKEIKEEPKEEEMTEEEKAAQKAKPVATAPIPGTPWCVVWTGDERVFFYNPTTRLSMWDRPDDLIGRADVDKIIQEPPHKKGMEELKKLRHPTPTMLSIQKWQFSMSAIKEEQELMEEINEDEPVKAKKRKRDDNKDIDSEKEAAMEAEIKAARERAIVPLEARMKQFKDMLLERGVSAFSTWEKELHKIVFDPRYLLLNPKERKQVFDQYVKTRAEEERREKKNKIMQAKEDFKKMMEEAKFNPRATFSEFAAKHAKDSRFKAIEKMKDREALFNEFVAAARKKEKEDSKTRGEKIKSDFFELLSNHHLDSQSRWSKVKDKVESDPRYKAVDSSSMREDLFKQYIEKIAKNLDSEKEKELERQARIEASLREREREVQKARSEQTKEIDREREQHKREEAIQNFKALLSDMVRSSDVSWSDTRRTLRKDHRWESGSLLEREEKEKLFNEHIEALTKKKREHFRQLLDETSAITLTSTWKEVKKIIKEDPRCIKFSSSDRKKQREFEEYIRDKYITAKADFRTLLKETKFITYRSKKLIQESDQHLKDVEKILQNDKRYLVLDCVPEERRKLIVAYVDDLDRRGPPPPPTASEPTRRSTK

SEQ ID NO: 10640 - protein, 433 aa, Homo sapiens
MRQSHQLPLVGLLLFSFIPSQLCEICEVSEENYIRLKPLLNTMIQSNYNRGTSAVNVVLSLKLVGIQIQTLMQKMIQQIKYNVKSRLSDVSSGELALIILALGVCRNAEENLIYDYHLIDKLENKFQAEIENMEAHNGTPLTNYYQLSLDVLALCLFNGNYSTAEVVNHFTPENKNYYFGSQFSVDTGAMAVLALTCVKKSLINGQIKADEGSLKNISIYTKSLVEKILSEKKENGLIGNTFSTGEAMQALFVSSDYYNENDWNCQQTLNTVLTEISQGAFSNPNAAAQVLPALMGKTFLDINKDSSCVSASGNFNISADEPITVTPPDSQSYISVNYSVRINETYFTNVTVLNGSVFLSVMEKAQKMNDTIFGFTMEERSWGPYITCIQGLCANNNDRTYWELLSGGEPLSQGAGSYVVRNGENLEVRWSKY

SEQ ID NO: 10641 - protein, 411 aa, Homo sapiens
MERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 10642 - protein, 929 aa, Homo sapiens
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDRLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 10643 - protein, 410 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 10644 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 10645 - protein, 1953 aa, Homo sapiens
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 10646 - protein, 958 aa, Homo sapiens
MSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWA

SEQ ID NO: 10647 - protein, 175 aa, Homo sapiens
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKTSPCRSQVLPEAGAGEDSPGRNMDTALEELQLPPNAEGHVKQAMLFNVENGTPASREALWLSEE

SEQ ID NO: 10648 - protein, 222 aa, Homo sapiens
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFEHSYSVMDSPKKLKHKLDHVIGELEDTKESLRNVLDREKRFQKSLRKTIRELKDECLISQETANRLDTFCWDCCQESIEQDYIS

SEQ ID NO: 10649 - protein, 784 aa, Homo sapiens
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 10650 - protein, 221 aa, Homo sapiens
MAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 10651 - protein, 247 aa, Homo sapiens
MAGGVRPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 10652 - protein, 575 aa, Homo sapiens
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 10653 - protein, 114 aa, Homo sapiens
MEKPLFPLVPLHWFGFGYTALVVSGGIVGYVKTGSVPSLAAWLLFGSLAGLGAYQLYQDPRNVWGFLAATSVTFVGVMGMRSYYYGKFMPVGLIAGASLLMAAKVGVRMLMTSD

SEQ ID NO: 10654 - protein, 479 aa, Homo sapiens
MLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKPIAAVVLGILFINTLRCVLRSGEWRSEEQLFRSALSVCPLNAKVHYNIGKNLADKGNQTAAIRNYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQEYKESEALFLKAIKANPNAASYHGNLAVLYHRWGHLDLAKKHYEISLQLDPTASGTKENYGLLRRKLELMQKKAV

SEQ ID NO: 10655 - protein, 1327 aa, Homo sapiens
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGFGRKDVVEHLLQMGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKMNALDTLGQTALHRAALAGHLQTCRLLLSYGSDPSIISLQGFTAAQMGNEAVQQILSESTPIRTSDVDYRLLEASKAGDLETVKQLCSSQNVNCRDLEGRHSTPLHFAAGYNRVSVVEYLLHHGADVHAKDKGGLVPLHNACSYGHYEVAELLVRHGASVNVADLWKFTPLHEAAAKGKYEICKLLLKHGADPTKKNRDGNTPLDLVKEGDTDIQDLLRGDAALLDAAKKGCLARVQKLCTPENINCRDTQGRNSTPLHLAAGYNNLEVAEYLLEHGADVNAQDKGGLIPLHNAASYGHVDIAALLIKYNTCVNATDKWAFTPLHEAAQKGRTQLCALLLAHGADPTMKNQEGQTPLDLATADDIRALLIDAMPPEALPTCFKPQATVVSASLISPASTPSCLSAASSIDNLTGPLAELAVGGASNAGDGAAGTERKEGEVAGLDMNISQFLKSLGLEHLRDIFETEQITLDVLADMGHEELKEIGINAYGHRHKLIKGVERLLGGQQGTNPYLTFHCVNQGTILLDLAPEDKEYQSVEEEMQSTIREHRDGGNAGGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMAHAPPGHHSVIGRPSVNGLAYAEYVIYRGEQAYPEYLITYQIMKPEAPSQTATAAEQKT

SEQ ID NO: 10656 - protein, 1729 aa, Homo sapiens
MKVSTLRESSAMASPLPREMEEELVPTGSEPGDTRAKPPVKPKPRALPAKPALPAKPSLLVPVGPRPPRGPLAELPSARKMNMPAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEERSLPSDLAFNGDLAKAASSELPADISKPWIPSSPAPSSENGGPASPGLPAEASGSGPGSPHLHPPDKSSPCHSQLLEAQSPEASQASPCPAVTPSAPSAALPDEGSRHTPSPGLPAEGAPEAPRPSSPPPEVLEPHSLDQPPATSSRPLIEVGELLDLTRTFPSGGEEEAKGDAHLRPTSLVQRRFSEGVLQSPSQDQEKLGGSLAALPQGQGSQLALDRPFGAESNWSLSQSFEWTFPTRPSGLGVWRLDSPPPSPITEASEAAEAAEAGNLAVSSREEGVSQQGQGAGSAPSGSGSSWVQGDDPSMSLTQKGDGESQPQFPAVPLEPLPTTEGTPGLPLQQAEERYESQEPLAGQESPLSLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPFGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 10657 - protein, 1445 aa, Homo sapiens
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 10658 - protein, 1621 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 10659 - protein, 1001 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 10660 - protein, 172 aa, Homo sapiens
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 10661 - protein, 282 aa, Homo sapiens
MSDVEENNFEGRESRSQSKSPTGTPARVKSESRSGSRSPSRVSKHSESHSRSRSKSRSRSRRHSHRRYTRSRSHSHSHRRRSRSRSYTPEYRRRRSRSHSPMSNRRRHTGSRANPDPNTCLGVFGLSLYTTERDLREVFSRYGPLSGVNVVYDQRTGRSRGFAFVYFERIDDSKEAMERANGMELDGRRIRVDYSITKRAHTPTPGIYMGRPTHSGGGGGGGGGGGGGGGGRRRDSYYDRGYDRGYDRYEDYDYRYRRRSPSPYYSRYRSRSRSRSYSPRRY

SEQ ID NO: 10662 - protein, 145 aa, Homo sapiens
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 10663 - protein, 219 aa, Homo sapiens
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 10664 - protein, 344 aa, Homo sapiens
MASGVGAAFEELPHDGTCDECEPDEAPGAEEVCRECGFCYCRRHAEAHRQKFLSHHLAEYVHGSQAWTPPADGEGAGKEEAEVKVEQEREIESEAGEESESEEESESEEESETEEESEDESDEESEEDSEEEMEDEQESEAEEDNQEEGESEAEGETEAESEFDPEIEMEAERVAKRKCPDHGLDLSTYCQEDRQLICVLCPVIGAHQGHQLSTLDEAFEELRSKDSGGLKAAMIELVERLKFKSSDPKVTRDQMKMFIQQEFKKVQKVIADEEQKALHLVDIQEAMATAHVTEILADIQSHMDRLMTQMAQAKEQLDTSNESAEPKAEGDEEGPSGASEEEDT

SEQ ID NO: 10665 - protein, 839 aa, Homo sapiens [sequence omitted]

SEQ ID NO: 10666 - protein, 839 aa, Homo sapiens [sequence omitted]

SEQ ID NO: 10667 - protein, 839 aa, Homo sapiens [sequence omitted]

SEQ ID NO: 10668 - protein, 839 aa, Homo sapiens [sequence omitted]

SEQ ID NO: 10669 - protein, 1164 aa, Homo sapiens
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 10670 - protein, 297 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHLGSFYAPRVWWMFRVFGHRTVSVLNGGFRNWLKEGHPVTSEPSRPEPAVFKATLDRSLLKTYEQVLENLESKRFQLVDSRSQGRFLGTEPEPDAVGLDSGHIRGAVNMPFMDFLTEDGFEKGPEELRALFQTKKVDLSQPLIATCRKGVTACHVALAAYLCGKPDVAVYDGSWSEWFRRAPPESRVSQGKSEKA

SEQ ID NO: 10671 - protein, 644 aa, Homo sapiens
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 10672 - protein, 450 aa, Homo sapiens
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 10673 - protein, 907 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGRKGGELASAVHAYTKTGDPYMRSLVQHILSLVSHPVLSFLYRWIYDGELEDTYHEFFVASDPTVKTDRLWHDKYTLRKSMIPSFMTMDQSRKVLLIGKSINFLHQVCHDQTPTTKMIAVTKSAESPQDAADLFTDLENAFQGKIDAAYFETSKYLLDVLNKKYSLLDHMQAMRRYLLLGQGDFIRHLMDLLKPELVRPATTLYQHNLTGILETAVRATNAQFDSPEILRRLDVRLLEVSPGDTGWDVFSLDYHVDGPIATVFTRECMSHYLRVFNFLWRAKRMEYILTDIRKGHMCNAKLLRNMPEFSGVLHQCHILASEMVHFIHQMQYYITFEVLECSWDELWNKVQQAQDLDHIIAAHEVFLDTIISRCLLDSDSRALLNQLRAVFDQIIELQNAQDAIYRAALEELQRRLQFEEKKKQREIEGQWGVTAAEEEEENKRIGEFKESIPKMCSQLRILTHFYQGIVQQFLVLLTTSSDESLRFLSFRLDFNEHYKAREPRLRVSLGTRGRRSSHT

SEQ ID NO: 10674 - protein, 678 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPGDAVWTD

SEQ ID NO: 10675 - protein, 1543 aa, Homo sapiens
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGVLGMSWNYPIFLVEDSSESDTDSDDYAPPQDGPAAYPIPVQNIKPLLTVSFTSGDISLMNNYDDLSPTVIRSGLKEVVAQWCTQGDLLAVAGMERQTQLGELPNGPLLKSAMVKFYNVRGEHIFTLDTLVQRPIISICWGHRDSRLLMASGPALYVVRVEHRVSSLQLLCQQAIASTLREDKDVSKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKPDEIYGNSLISTVIDSCNCSDSSDIELSDDWAAKKSPKISRASKSPKLPRISIEARKSPKLPRAAQELSRSPRLPLRKPSVGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPVTGASGVPENSPPCTVNIPIAPIHSSAQAMSPTQSIGLVQSLLANQNVQLDVLTNQTTAVGTAEHAGDSATQYPVSNRYSNPGQVIFGSVEMGRIIQNPPPLSLPPPPQGPMQLSTVGHGDRDHEHLQKSAKALRPTPQLAAEGDAVVFSAPQEVQVTKINPPPPYPGTIPAAPTTAAPPPPLPPPQPPVDVCLKKGDFSLYPTSVHYQTPLGYERITTFDSSGNVEEVCRPRTRMLCSQNTYTLPGPGSSATLRLTATEKKVPQPCSSATLNRLTVPRYSIPTGDPPPYPEIASQLAQGRGAAQRSDNSLIHATLRRNNREATLKMAQLADSPRAPLQPLAKSKGGPGGVVTQLPARPPPALYTCSQCSGTGPSSQPGASLAHTASASPLASQSSYSLLSPPDSARDRTDYVNSAFTEDEALSQHCQLEKPLRHPPLPEAAVTLKRPPPYQWDPMLGEDVWVPQERTAQTSGPNPLKLSSLMLSQGQHLDVSRLPFISPKSPASPTATFQTGYGMGVPYPGSYNNPPLPGVQAPCSPKDALSPTQFAQQEPAVVLQPLYPPSLSYCTLPPMYPGSSTCSSLQLPPVALHPWSSYSACPPMQNPQGTLPPKPHLVVEKPLVSPPPADLQSHLGTEVMVETADNFQEVLSLTESPVPQRTEKFGKKNRKRLDSRAEEGSVQAITEGKVKKEARTLSDFNSLISSPHLGREKKKVKSQKDQLKSKKLNKTNEFQDSSESEPELFISGDELMNQSQGSRKGWKSKRSPRAAGELEEAKCRRASEKEDGRLGSQGFVYVMANKQPLWNEATQVYQLDFGGRVTQESAKNFQIELEGRQVMQFGRIDGSAYILDFQYPFSAVQAFAVALANVTQRLK

SEQ ID NO: 10676 - protein, 229 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 10677 - protein, 685 aa, Homo sapiens
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPSDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 10678 - protein, 73 aa, Homo sapiens
MIEVVCNDRLGKKVRVKCNTDDTIGDLKKLIAAQTGTRWNKIVLKKWYTIFKDHVSLGDYEIHDGMNLELYYQ

SEQ ID NO: 10679 - protein, 380 aa, Homo sapiens
MSLSDWHLAVKLADQPLTPKSILRLPETELGEYSLGGYSISFLKQLIAGKLQESVPDPELIDLIYCGRKLKDDQTLDFYGIQPGSTVHVLRKSWPEPDQKPEPVDKVAAMREFRVLHTALHSSSSYREAVFKMLSNKESLDQIIVATPGLSSDPIALGVLQDKDLFSVFADPNMLDTLVPAHPALVNAIVLVLHSVAGSAPMPGTDSSSRSMPSSSYRDMPGGFLFEGLSDDEDDFHPNTRSTPSSSTPSSRPASLGYSGAAGPRPITQSELATALALASTPESSSHTPTPGTQGHSSGTSPMSSGVQSGTPITNDLFSQALQHALQASGQPSLQSQWQPQLQQLRDMGIQDDELSLRALQATGGDIQAALELIFAGGAP

SEQ ID NO: 10680 - protein, 380 aa, Homo sapiens; identical to SEQ ID NO: 10679

SEQ ID NO: 10681 - protein, 1749 aa, Homo sapiens
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEESTPAVSDYSRIALGPKRGPSVTEKEVLTCILCQEEQEVKIENNAMVLSACVQKSTALTQHRGKPIELSGEALDPLFMDPDLAYGTYTGSCGHVMHAVCWQKYFEAVQLSSQQRIHVDLFDLESGEYLCPLCKSLCNTVIPIIPLQPQKINSENADALAQLLTLARWIQTVLARISGYNIRHAKGENPIPIFFNQGMGDSTLEFHSILSFGVESSIKYSNSIKEMVILFATTIYRIGLKVPPDERDPRVPMLTWSTCAFTIQAIENLLGDEGKPLFGALQNRQHNGLKALMQFAVAQRITCPQVLIQKHLVRLLSVVLPNIKSEDTPCLLSIDLFHVLVGAVLAFPSLYWDDPVDLQPSSVSSSYNHLYLFHLITMAHMLQILLTVDTGLPLAQVQEDSEEAHSASSFFAEISQYTSGSIGCDIPGWYLWVSLKNGITPYLRCAALFFHYLLGVTPPEELHTNSAEGEYSALCSYLSLPTNLFLLFQEYWDTVRPLLQRWCADPALLNCLKQKNTVVRYPRKRNSLIELPDDYSCLLNQASHFRCPRSADDERKHPVLCLFCGAILCSQNICCQEIVNGEEVGACIFHALHCGAGVCIFLKIRECRVVLVEGKARGCAYPAPYLDEYGETDPGLKRGNPLHLSRERYRKLHLVWQQHCIIEEIARSQETNQMLFGFNWQLL

SEQ ID NO: 10682 - protein, 329 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNSMLSAIQSEVAKNQMLIEEEVQKLKRYKIENIRRKHNYLPFIMELLKTLAEHQQLIPLVEKAKEKQNAKKAQETK

SEQ ID NO: 10683 - protein, 929 aa, Homo sapiens
MTASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 10684 - protein, 944 aa, Homo sapiens
MTVSGPGTPEPRPATPGASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 10685 - protein, 931 aa, Homo sapiens
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIKLDAEACHILTENLSTYALVGHSTTKAAAKRLKLAIFGPLCCSSLEYSIRVYCLDDTQDALKEILHLERQTGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 10686 - protein, 922 aa, Homo sapiens
MASPGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDSSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 10687 - protein, 747 aa, Homo sapiens
MAPGWPSLSAGSRQEAPQLAAGGSAYQAVGRQFQPRATALQGPSQVTATGGPANSSRLGGAFGWESAGPGWRPDLRRSSSSPRLFAAELRPAQTGSVLGLTSRAAQPQHAPASPVLWKRQGTSSRQGPGRRLCTRRTILRAYDNSRRAQRRRSAAAAARGRCLPCSLPSAIAQPHLCPASALCSRRPGLGQPGQPPSSPHAALASSSPPSPPPPARGRALPPMVSRPEPEGEAMDAELAVAPPGCSHLGSFKVDNWKQNLRAIYQCFVWSGTAEARKRKAKSCICHVCGVHLNRLHSCLYCVFFGCFTKKHIHEHAKAKRHNLAIDLMYGGIYCFLCQDYIYDKDMEIIAKEEQRKAWKMQGVGEKFSTWEPTKRELELLKHNPKRRKITSNCTIGLRGLINLGNTCFMNCIVQALTHTPLLRDFFLSDRHRCEMQSPSSCLVCEMSSLFQEFYSGHRSPHIPYKLLHLVWTHARHLAGYEQQDAHEFLIAALDVLHRHCKGDDNGKKANNPNHCNCIIDQIFTGGLQSDVTCQVCHGVSTTIDPFWDISLDLPGSSTPFWPLSPGSEGNVVNGESHVSGTTTLTDCLRRFTRPEHLGSSAKIKCSGCHSYQESTKQLTMKKLPIVACFHLKRFEHSAKLRRKITTYVSFPLELDMTPFMASSKESRMNGQYQQPTDSLNNDNKYSLFAVVNHQGTLESGHYTSFIRQHKDQWFKCDDAIITKASIKDVLDSEGYLLFYHKQFLEYE

SEQ ID NO: 10688 - protein, 556 aa, Homo sapiens [sequence omitted]

SEQ ID NO: 10689 - protein, 556 aa, Homo sapiens [sequence omitted]

SEQ ID NO: 10690 - protein, 556 aa, Homo sapiens [sequence omitted]

SEQ ID NO: 10691 - protein, 1604 aa, Homo sapiens
MGAKESRIGFLSYEEALRRVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHKVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYVELKDSDGRPDWEVAAEAWDNHLRRNRSIVVDLFHGQLRSQVKCKTCGHISVRFDPFNFLSLPLPMDSYMHLEITVIKLDGTTPVRYGLRLNMDEKYTGLKKQLSDLCGLNSEQILLAEVHGSNIKNFPQDNQKVRLSVSGFLCAFEIPVPVSPISASSPTQTDFSSSPSTNEMFTLTTNGDLPRPIFIPNGMPNTVVPCGTEKNFTNGMVNGHMPSLPDSPFTGYIIAVHRKMMRTELYFLSSQKNRPSLFGMPLIVPCTVHTRKKDLYDAVWIQVSRLASPLPPQEASNHAQDCDDSMGYQYPFTLRVVQKDGNSCAWCPWYRFCRGCKIDCGEDRAFIGNAYIAVDWDPTALHLRYQTSQERVVDEHESVEQSRRAQAEPINLDSCLRAFTSEEELGENEMYYCSKCKTHCLATKKLDLWRLPPILIIHLKRFQFVNGRWIKSQKIVKFPRESFDPSAFLVPRDPALCQHKPLTPQGDELSEPRILAREVKKVDAQSSAGEEDVLLSKSPSSLSANIISSPKGSPSSSRKSGTSCPSSKNSSPNSSPRTLGRSKGRLRLPQIGSKNKLSSSKENLDASKENGAGQICELADALSRGHVLGGSQPELVTPQDHEVALANGFLYEHEACGNGYSNGQLGNHSEEDSTDDQREDTRIKPIYNLYAISCHSGILGGGHYVTYAKNPNCKWYCYNDSSCKELHPDEIDTDSAYILFYEQQGIDYAQFLPKTDGKKMADTSSMDEDFESDYKKYCVLQ

SEQ ID NO: 10692 - protein, 845 aa, Homo sapiens
MRTEAVVNSQGQTDYLTKDSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 10693 - protein, 828 aa, Homo sapiens
MNSDQDVALKLAQERAEIVAKYDRGREGAEIEPWEDADYLVYKVTDRFGFLHEEELPDHNVAVERQKHLEIERTTKWLKMLKGWEKYKNTEKFHRRIYKGIPLQLRGEVWALLLEIPKMKEETRDLYSKLKHRARGCSPDIRQIDLDVNRTFRDHIMFRDRYGVKQQSLFHVLAAYSIYNTEVGYCQGMSQITALLLMYMNEEDAFWALVKLFSGPKHAMHGFFVQGFPKLLRFQEHHEKILNKFLSKLKQHLDSQEIYTSFYTMKWFFQCFLDRTPFTLNLRIWDIYIFEGERVLTAMSYTILKLHKKHLMKLSMEELVEFFQETLAKDFFFEDDFVIEQLQISMTELKRAKLDLPEPGKEDEYPKKPLGQLPPELQSWGVHHLSNGQRSVGRPSPLASGRRESGAPHRRHEHSPHPQSRTGTPERAQPPRRKSVEEESKKLKDEADFQRKLPSGPQDSSRQYNHAAANQNSNATSNIRKEFVPKWNKPSDVSATERTAKYTMEGKGRAAHPALAVTVPGPAEVRVSNVRPKMKALDAEDGKRGSTASQYDNVPGPELDSGASVEEALERAYSQSPRHALYPPSPRKHAEPSSSPSKVSNKFTFKVQPPSHARYPSQLDGEARGLAHPPSYSNPPVYHGNSPKHFPTANSSFASPQFSPGTQLNPSRRPHGSTLSVSASPEKSYSRPSPLVLPSSRIEVLPVDTGAGGYSGNSGSPKNGKLIIPPVDYLPDNRTWSEVSYTYRPETQGQSWTRDASRGNLPKYSAFQLAPFQDHGLPAVSVDSPVRYKASPAAEDASPSGYPYSGPPPPAYHYRNRDGLSIQESVLL

SEQ ID NO: 10694 - protein, 191 aa, Homo sapiens [sequence omitted]

SEQ ID NO: 10695 - protein, 828 aa, Homo sapiens; identical to SEQ ID NO: 10693

SEQ ID NO: 10696 - protein, 191 aa, Homo sapiens [sequence omitted]

SEQ ID NO: 10697 - protein, 845 aa, Homo sapiens; identical to SEQ ID NO: 10692

SEQ ID NO: 10698 - protein, 1102 aa, Homo sapiens
MNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMTGRHQYINEDEYEVNLKDFEPQPGNMSHPRPWLGLDHFNKAPKRSRYTYLEKAIKIHN

SEQ ID NO: 10699 - protein, 2570 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLFNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEVKKATSVQQIEMEESKEPDDQDAPDEHESPPPEDAPLYPHSPGSQYQQNNHVHGQPYTGPAAHHMNNPQRTGQRAQENYEGSEEVSPPQTKDQ

SEQ ID NO: 10700 - protein, 2554 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLFNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 10701 - protein, 406 aa, Homo sapiens
MKKKQQHPGGGADPWPHGAPMGGAPPGLGSWKRRVPLLPFLRFSLRDYGFCMATLLVFCLGSLLYQLSGGPPRFLLDLRQYLGNSTYLDDHGPPPSKVLPFPSQVVYNRVGKCGSRTVVLLLRILSEKHGFNLVTSDIHNKTRLTKNEQMELIKNISTAEQPYLFTRHVHFLNFSRFGGDQPVYINIIRDPVNRFLSNYFFRRFGDWRGEQNHMIRTPSMRQEERYLDINECILENYPECSNPRLFYIIPYFCGQHPRCREPGEWALERAKLNVNENFLLVGILEELEDVLLLLERFLPHYFKGVLSIYKDPEHRKLGNMTVTVKKTVPSPEAVQILYQRMRYEYEFYHYVKEQFHLLKRKFGLKSHVSKPPLRPHFFIPTPLETEEPIDDEEQDDEKWLEDIYKR

SEQ ID NO: 10702 - protein, 839 aa, Homo sapiens
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPVFTPRVIGTAVARYNFAARDMRELSLREGDVVRIYSRIGGDQGWWKGETNGRIGWFPSTYVEEEGIQ

SEQ ID NO: 10703 - protein, 186 aa, Homo sapiens
MFGKPDKMDVRCHSDAEAARVSKNAHKESRESKGAEGNLPAAFLKEPQGAFSASGAAEDCNKSKSNSAADPDYCRRILVRDAKGSIREIILPKGLDLDRPKRTRTSFTAEQLYRLEMEFQRCQYVVGRERTELARQLNLSETQANSEENNERFKRGIKKQKKKRKKEPANDESRRGDSGGRGWQPL

SEQ ID NO: 10704 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 10705 - protein, 203 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRGCSVKKQCNLSLAPKA

SEQ ID NO: 10706 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 10707 - protein, 505 aa, Homo sapiens
MSSVQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHNSGPPPPPARGRGAPPPPPSRAPTAAPPPPPPSRPSVAVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVADGQESTPPTPAPTSGIVGALMEVMQKRSKAIHSSDEDEDEDDEEDFEDDDEWED

SEQ ID NO: 10708 - protein, 641 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRKPPGPPPGPPPPQVVQMYGRKVGFALDLPPRRRDEDMLYSPELAQRGHDDDVSSTSEDDGYPEDMDQDKHDDSTDDSDTDKSDGESDGDEFVHRDNGERDNNEEKKSGLSVRFADMPGKSRKKKKNMKELTPLQAMMLRMAGQEIPEEGREVEEFSEDDDEDDSDDSEAEKQSQKQHKEESHSDGTSTASSQQQAPPQSVPPSQIQAPPMPGPPPLGPPPAPPLRPPGPPTGLPPGPPPGAPPFLRPPGMPGLRGPLPRLLPPGPPPGRPPGPPPGPPPGLPPGPPPRGPPPRLPPPAPPGIPPPRPGMMRPPLVPPLGPAPPGLFPPAPLPNPGVLSAPPNLIQRPKADDTSAATIEKKATATISAKPQITNPKAEITRFVPTALRVRRENKGATAAPQRKSEDDSAVPLAKAAPKSGPSVPVSVQTKDDVYEAFMKEMEGLL

SEQ ID NO: 10709 - protein, 410 aa, Homo sapiens
MAAEIHSRPQSSRPVLLSKIEGHQDAVTAALLIPKEDGVITASEDRTIRVWLKRDSGQYWPSIYHTMASPCSAMAYHHDSRRIFVGQDNGAVMEFHVSEDFNKMNFIKTYPAHQNRVSAIIFSLATEWVISTGHDKCVSWMCTRSGNMLGRHFFTSWASCLQYDFDTQYAFVGDYSGQITLLKLEQNTCSVITTLKGHEGSVACLWWDPIQRLLFSGASDNSIIMWDIGGRKGRTLLLQGHHDKVQSLCYLQLTRQLVSCSSDGGIAVWNMDVSREEAPQWLESDSCQKCEQPFFWNIKQMWDTKTLGLRQHHCRKCGQAVCGKCSSKRSSYPVMGFEFQVRVCDSCYDSIKDEDRTSLATFHEGKHNISHMSMDIARGLMVTCGTDRIVKIWDMTPVVGCSLATGFSPH

SEQ ID NO: 10710 - protein, 514 aa, Homo sapiens
MQESGCRLEHPSATKFRNHVMEGDWDKAENDLNELKPLVHSPHAIVVRGALEISQTLLGIIVRMKFLLLQQKYLEYLEDGKVLEALQVLRCELTPLKYNTERIHVLSGYLMCSHAEDLRAKAEWEGKGTASRSKLLDKLQTYLPPSVMLPPRRLQTLLRQAVELQRDRCLYHNTKLDNNLDSVSLLIDHVCSRRQFPCYTQQILTEHCNEVWFCKFSNDGTKLATGSKDTTVIIWQVDPDTHLLKLLKTLEGHAYGVSYIAWSPDDNYLVACGPDDCSELWLWNVQTGELRTKMSQSHEDSLTSVAWNPDGKRFVTGGQRGQFYQCDLDGNLLDSWEGVRVQCLWCLSDGKTVLASDTHQRIRGYNFEDLTDRNIVQEDHPIMSFTISKNGRLALLNVATQGVHLWDLQDRVLVRKYQGVTQGFYTIHSCFGGHNEDFIASGSEDHKVYIWHKRSELPIAELTGHTRTVNCVSWNPQIPSMMASASDDGTVRIWGPAPFIDHQNIEEECSSMDS

SEQ ID NO: 10711 - protein, 453 aa, Homo sapiens
MARKVVSRKRKAPASPGAGSDAQGPQFGWDHSLHKRKRLPPVKRSLVYYLKNREVRLQNETSYSRVLHGYAAQQLPSLLKEREFHLGTLNKVFASQWLNHRQVVCGTKCNTLFVVDVQTSQITKIPILKDREPGGVTQQGCGIHAIELNPSRTLLATGGDNPNSLAIYRLPTLDPVCVGDDGHKDWIFSIAWISDTMAVSGSRDGSMGLWEVTDDVLTKSDARHNVSRVPVYAHITHKALKDIPKEDTNPDNCKVRALAFNNKNKELGAVSLDGYFHLWKAENTLSKLLSTKLPYCRENVCLAYGSEWSVYAVGSQAHVSFLDPRQPSYNVKSVCSRERGSGIRSVSFYEHIITVGTGQGSLLFYDIRAQRFLEERLSACYGSKPRLAGENLKLTTGKGWLNHDETWRNYFSDIDFFPNAVYTHCYDSSGTKLFVAGGPLPSGLHGNYAGLWS

SEQ ID NO: 10712 - protein, 220 aa, Homo sapiens
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 10713 - protein, 645 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILSSVPTTEVSTGVKFQVGDLVWSKVGTYPWWPCMVSSDPQLEVHTKINTRGAREYHVQFFSNQPERAWVHEKRVREYKGHKQYEELLAEATKQASNHSEKQKIRKPRPQRERAQWDIGIAHAEKALKMTREERIEQYTFIYIDKQPEEALSQAKKSVASKTEVKKTRRPRSVLNTQPEQTNAGEVASSLSSTEIRRHSQRRHTSAEEEEPPPVKIAWKTAAARKSLPASITMHKGSLDLQKCNMSPVVKIEQVFALQNATGDGKFIDQFVYSTKGIGNKTEISVRGQDRLIISTPNQRNEKPTQSVSSPEATSGSTGSVEKKQQRRSIRTRSESEKSTEVVPKKKIKKEQVETVPQATVKTGLQKGSADRGVQGSVRFSDSSVSAAIEETVD

SEQ ID NO: 10714 - protein, 528 aa, Homo sapiens
MASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 10715 - protein, 2217 aa, Homo sapiens
MDGDGGRRDVPGTLMEPGRGAGPAGMAEPRAKAARPGPQRFLRRSVVESDQEEPPGLEAAEAPGPQPPQPLQRRVLLLCKTRRLIAERARGRPAAPAPAALVAQPGAPGAPADAGPEPVGTQEPGPDPIAAAVETAPAPDGGPREEAAATVRKEDEGAAEAKPEPGRTRRDEPEEEEDDEDDLKAVATSLDGRFLKFDIELGRGSFKTVYKGLDTETWVEVAWCELQDRKLTKLERQRFKEEAEMLKGLQHPNIVRFYDFWESSAKGKRCIVLVTELMTSGTLKTYLKRFKVMKPKVLRSWCRQILKGLLFLHTRTPPIIHRDLKCDNIFITGPTGSVKIGDLGLATLKRASFAKSVIGTPEFMAPEMYEEHYDESVDVYAFGMCMLEMATSEYPYSECQNAAQIYRKVTCGIKPASFEKVHDPEIKEIIGECICKNKEERYEIKDLLSHAFFAEDTGVRVELAEEDHGRKSTIALRLWVEDPKKLKGKPKDNGAIEFTFDLEKETPDEVAQEMIESGFFHESDVKIVAKSIRDRVALIQWRRERIWPALQPKEQQDVGSPDKARGPPVPLQVQVTYHAQAGQPGPPEPEEPEADQHLLPPTLPTSATSLASDSTFDSGQGSTVYSDSQSSQQSVMLGSLADAAPSPAQCVCSPPVSEGPVLPQSLPSLGAYQQPTAAPGLPVGSVPAPACPPSLQQHFPDPAMSFAPVLPPPSTPMPTGPGQPAPPGQQPPPLAQPTPLPQVLAPQPVVPLQPVPPHLPPYLAPASQVGAPAQLKPLQMPQAPLQPLAQVPPQMPPIPVVPPITPLAGIDGLPPALPDLPTATVPPVPPPQYFSPAVILPSLAAPLPPASPALPLQAVKLPHPPGAPLAMPCRTIVPNAPATIPLLAVAPPGVAALSIHSAVAQLPGQPVYPAAFPQMAPTDVPPSPHHTVQNMRATPPQPALPPQPTLPPQPVLPPQPTLPPQPVLPPQPTRPPQPVLPPQPMLPPQPVLPPQPALPVRPEPLQPHLPEQAAPAATPGSQILLGHPAPYAVDVAAQVPTVPVPPAAVLSPPLPEVLLPAAPELLPQFPSSLATVSASVQSVPTQTATLLPPANPPLPGGPGIASPCPTVQLTVEPVQEEQASQDKPPGLPQSCESYGGSDVTSGKELSDSCEGAFGGGRLEGRAARKHHRRSTRARSRQERASRPRLTILNVCNTGDKMVECQLETHNHKMVTFKFDLDGDAPDEIATYMVEHDFILQAERETFIEQMKDVMDKAEDMLSEDTDADRGSDPGTSPPHLSTCGLGTGEESRQSQANAPVYQQNVLHTGKRWFIICPVAEHPAPEAPESSPPLPLSSLPPEASQDSAPYKDQLSSKEQPSFLASQQLLSQAGPSNPPGAPPAPLAPSSPPVTALPQDGAAPATSTMPEPASGTASQAGGPGTPQGLTSELETSQPLAETHEAPLAVQPLVVGLAPCTPAPEAASTRDASAPREPLPPPAPEPSPHSGTPQPALGQPAPLLPAAVGAVSLATSQLPSPPLGPTVPPQPPSALESDGEGPPPRVGFVDSTIKSLDEKLRTLLYQEHVPTSSASAGTPVEVGDRDFTLEPLRGDQPRSEVCGGDLALPPVPKEAVSGRVQLPQPLVEKSELAPTRGAVMEQGTSSSMTAESSPRSMLGYDRDGRQVASDSHVVPSVPQDVPAFVRPARVEPTDRDGGEAGESSAEPPPSDMGTVGGQASHPQTLGARALGSPRKRPEQQDVSSPAKTVGRFSVVSTQDEWTLASPHSLRYSAPPDVYLDEAPSSPDVKLAVRRAQTASSIEVGVGEPVSSDSGDEGPRARPPVQKQASLPVSGSVAGDFVKKATAFLQRPSRAGSLGPETPSRVGMKVPTISVTSFHSQSSYISSDNDSELEDADIKKELQSLREKHLKEISELQSQQKQEIEALYRRLGKPLPPNVGFFHTAPPTGRRRKTSKSKLKAGKLLNPLVRQLKVVASSTGHLADSSRGPPAKDPAQASVGLTADSTGLSGKAVQTQQPCSVRASLSSDICSGLASDGGGARGQGWTVYHPTSERVTYKSSSKPRARFLSGPVSVSIWSALKRLCLGKEHSSRSSTSSLAPGPEPGPQPALHVQAQVNNSNNKKGTFTDDLHKLVDEWTSKTVGAAQLKPTLNQLKQTQKLQDMEAQAGWAAPGEARAMTAPRAGVGMPRLPPAPGPLSTTVIPGAAPTLSVPTPDPESEKPD

SEQ ID NO: 10716 - protein, 1113 aa, Homo sapiens
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 10717 - protein, 261 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 10718 - protein, 650 aa, Homo sapiens
MAAKSDGRLKMKKSSDVAFTPLQNSDHSGSVQGLAPGLPSGSGAEDEEAAGGGCCPDGGGCSRCCCCCAGSGGSAGSGGSGGVAGPGGGGAGSAALCLRLGREQRRYSLWDCLWILAAVAVYFADVGTDVWLAVDYYLRGQRWWFGLTLFFVVLGSLSVQVFSFRWFVHDFSTEDSATAAAASSCPQPGADCKTVVGGGSAAGEGEARPSTPQRQASNASKSNIAAANSGSNSSGATRASGKHRSASCSFCIWLLQSLIHILQLGQIWRYFHTIYLGIRSRQSGENDRWRFYWKMVYEYADVSMLHLLATFLESAPQLVLQLCIIVQTHSLQALQGFTAAASLVSLAWALASYQKALRDSRDDKKPISYMAVIIQFCWHFFTIAARVITFALFASVFQLYFGIFIVLHWCIMTFWIVHCETEFCITKWEEIVFDMVVGIIYIFSWFNVKEGRTRCRLFIYYFVILLENTALSALWYLYKAPQIADAFAIPALCVVFSSFLTGVVFMLMYYAFFHPNGPRFGQSPSCACEDPAAAFTLPPDVATSTLRSISNNRSVVSDRDQKFAERDGCVPVFQVRPTAPSTPSSRPPRIEESVIKIDLFRNRYPAWERHVLDRSLRKAILAFECSPSPPRLQYKDDALIQERLEYETTL

SEQ ID NO: 10719 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 10720 - protein, 409 aa, Homo sapiens
MAALENGELGPLLSPGTLRGLEDECVTDVKAQTRAALLRVLQEDEEHWGSLEDQPSSLAQDVCELLEEHTERAPRISQEFGERMAHCCLGGLAEFLQSFQQRVERFHENPAVREMLPDTYISKTIALVNCGPPLRALAERLARVGPPESEPAREASASALDHVTRLCHRVVANLLFQELQPHFNKLMRRKWLSSPEALDGIVGTLGAQALALRRMQDEPYQALVAELHRRALVEYVRPLLRGRLRCSSARTRSRVAGRLREDASQLQRLFRRLESQASWLDAVVPHLAEVMQLEDTPSIQVEVGVLVRDYPDIRQKHVAALLDIRGLRNTAARQEILAVARDLELSEEGALSPPRDRAFFADIPVPRPSFCLSLPLFLGRLPLSRLARPSLACLPRPRPPSLARPRAQR

SEQ ID NO: 10721 - protein, 257 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 10722 - protein, 257 aa, Homo sapiens; identical to SEQ ID NO: 10721

SEQ ID NO: 10723 - protein, 570 aa, Homo sapiens
MSASSLLEQRPKGQGNKVQNGSVHQKDGLNDDDFEPYLSPQARPNNAYTAMSDSYLPSYYSPSIGFSYSLGEAAWSTGGDTAMPYLTSYGQLSNGEPHFLPDAMFGQPGALGSTPFLGQHGFNFFPSGIDFSAWGNNSSQGQSTQSSGYSSNYAYAPSSLGGAMIDGQSAFANETLNKAPGMNTIDQGMAALKLGSTEVASNVPKVVGSAVGSGSITSNIVASNSLPPATIAPPKPASWADIASKPAKQQPKLKTKNGIAGSSLPPPPIKHNMDIGTWDNKGPVAKAPSQALVQNIGQPTQGSPQPVGQQANNSPPVAQASVGQQTQPLPPPPPQPAQLSVQQQAAQPTRWVAPRNRGSGFGHNGVDGNGVGQSQAGSGSTPSEPHPVLEKLRSINNYNPKDFDWNLKHGRVFIIKSYSEDDIHRSIKYNIWCSTEHGNKRLDAAYRSMNGKGPVYLLFSVNGSGHFCGVAEMKSAVDYNTCAGVWSQDKWKGRFDVRWIFVKDVPNSQLRHIRLENNENKPVTNSRDTQEVPLEKAKQVLKIIASYKHTTSIFDDFSHYEKRQRGRRKC

SEQ ID NO: 10724 - protein, 245 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 10725 - protein, 245 aa, Homo sapiens; identical to SEQ ID NO: 10724

SEQ ID NO: 10726 - protein, 170 aa, Homo sapiens
MATPMHRLIARRQAEANKQHVRCQKCLEFGHWTYECTGKRKYLHRPSRTAELKKALKEKENRLLLQQSIGETNVERKAKKKRSKSVTSSSSSSSDSSASDSSSESEETSTSSSSEDSDTDESSSSSSSSASSTTSSSSSDSDSDSSSSSSSSTSTDSSSDDEPPKKKKKK

SEQ ID NO: 10727 - protein, 513 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCELCNSCTSKDGRKWNHCFLCKKCVKPSWIHCSICNHCAVPDHSCEGPKHGCFICGELDHKRSTCPNIATSKRANKAVRKQKQRKSNKMKMETTKGQSMNHTSATRRKKRRERAHQYLGS

SEQ ID NO: 10728 - protein, 229 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFR

SEQ ID NO: 10729 - protein, 437 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCELCNSCTSKDGRKWNHCFLCKKCVKPSWIHCSICNHCAVPDHS

SEQ ID NO: 10730 - protein, 339 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQGI

SEQ ID NO: 10731 - protein, 513 aa, Homo sapiens [sequence omitted]

SEQ ID NO: 10732 - protein, 229 aa, Homo sapiens; identical to SEQ ID NO: 10728

SEQ ID NO: 10733 - protein, 437 aa, Homo sapiens
MAASRNGFEAVEAEGSAGCRGSSGMEVVLPLDPAVPAPLCPHGPTLLFVKVTQGKEETRRFYACSACRDRKDCNFFQWEDEKLSGARLAAREAHNRRCQPPLSRTQCVERYLKFIELPLTQRKFCQTCQQLLLPDDWGQHSEHQVLGNVSITQLRRPSQLLYPLENKKTNAQYLFADRSCQFLVDLLSALGFRRVLCVGTPRLHELIKLTASGDKKSNIKSLLLDIDFRYSQFYMEDSFCHYNMFNHHFFDGKTALEVCRAFLQEDKGEGIIMVTDPPFGGLVEPLAITFKKLIAMWKEGQSQDDSHKELPIFWIFPYFFESRICQFFPSFQMLDYQVDYDNHALYKHGKTGRKQSPVRIFTNIPPNKIILPTEEGYRFCSPCQRYVSLENQHCEHCNSCTSKDGRKWNHCFLCKKCVKPSWIHCSICNHCAVPDHS

SEQ ID NO: 10734 - protein, 339 aa, Homo sapiens; identical to SEQ ID NO: 10730

SEQ ID NO: 10735 - protein, 1214 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 10736 - protein, 519 aa, Homo sapiens
MARDLVMFRDVAVDFSQEEWECLNSYQRNLYRDVILENYSNLVSLAGCSISKPDVITLLEQGKEPWMVVRDEKRRWTLDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRVHQRIHIGEKPYECKECGKAFRVRGQLNLHQRIHTGEKPYECKECGKAFRQYAHLTRHQRLNIAEKCYECKECGQAFLCSTGLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 10737 - protein, 1004 aa, Homo sapiens
MSRRKQSNPRQIKRSLGDMEAGEEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPSPALTLLLVDEACWLRTLPQALTEAEANTEIHRKDDALWCRVTKPVPAGGLLSVLLTAEPHSTPGHPVKKEPAEPTCPAPAHDLQLLPQQAGMASILATAVINKDVFPCKDCGIWYRSERNLQAHLLYYCASRQGTGSPAAAATDEKPKETYPNERVCPFPQCRKSCPSASSLEIHMRSHSGERPFVCLICLSAFTTKANCERHLKVHTDTLSGVCHSCGFISTTRDILYSHLVTNHMVCQPGSKGEIYSPGAGHPATKLPPDSLGSFQQQHTALQGPLASADLGLAPTPSPGLDRKALAEATNGEARAAPQNGGSSEPPAAPRSIKVEAVEEPEAAPILGPGEPGPQAPSRTPSPRSPAPARVKAELSSPTPGSSPVPGELGLAGALFLPQYVFGPDAAPPASEILAKMSELVHSRLQQGAGAGAGGAQTGLFPGAPKGATCFECEITFSNVNNYYVHKRLYCSGRRAPEDAPAARRPKAPPGPARAPPGQPAEPDAPRSSPGPGAREEGAGGAATPEDGAGGRGSEGSQSPGSSVDDAEDDPSRTLCEACNIRFSRHETYTVHKRYYCASRHDPPPRRPAAPPGPPGPAAPPAPSPAAPVRTRRRRKLYELHAAGAPPPPPPGHAPAPESPRPGSGSGSGPGLAPARSPGPAADGPIDLSKKPRRPLPGAPAPALADYHECTACRVSFHSLEAYLAHKKYSCPAAPPPGALGLPAAACPYCPPNGPVRGDLLEHFRLAHGLLLGAPLAGPGVEARTPADRGPSPAPAPAASPQPGSRGPRDGLGPEPQEPPPGPPPSPAAAPEAVPPPPAPPSYSDKGVQTPSKGTPAPLPNGNHRYCRLCNIKFSSLSTFIAHKKYYCSSHAAEHVK

SEQ ID NO: 10738 - protein, 416 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 10739 - protein, 404 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 10740 - protein, 411 aa, Homo sapiens
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 10741 - protein, 573 aa, Homo sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 10742 - protein, 778 aa, Homo sapiens
MNKVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGNVIGIPFNMDVSSFPSRKMFCQYDSRGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 10743 - protein, 262 aa, Homo sapiens
MKRHEMVVAKHSALCSRFAQDLWLEQNIKDSFQKVTLSRYGKYGHKNLQLRKGCKSVDECKEHQGGYNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 10744 - protein, 463 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 10745 - protein, 478 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 10746 - protein, 423 aa, Homo sapiens [sequence omitted]

SEQ ID NO: 10747 - protein, 751 aa, Homo sapiens
MGPQGARRQAFLAFGDVTVDFTQKEWRLLSPAQRALYREVTLENYSHLVSLGILHSKPELIRRLEQGEVPWGEERRRRPGPCAGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 10748 - protein, 550 aa, Homo sapiens
MPLQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 10749 - protein, 513 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 10750 - protein, 271 aa, Homo sapiens
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYKCTECGKAFSQSICLTRHQRSHSGDKPFKCNECGKAFNQSACLMQHQRIHSGEKPYTCTECGKAFTQNSSLVEHERTHTGEKLYKCSECEKTFRKQAHLSEHYRIHTGEKPYECVGCGKSFRHSSALLRHQRLHAGE

SEQ ID NO: 10751 - protein, 444 aa, Homo sapiens
MGPLQFRDVAIEFSLEEWHCLDAAQRNLYRDVMLENYRNLIFLGIVVSKPNLITCLEQGKKPLTMKRHEMIAKPPVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 10752 - protein, 220 aa, Homo sapiens
MGPLQFRDVAIEFSLEEWHCLDAAQRNLYRDVMLENYRNLIFLGIVVSKPNLITCLEQGKKPLTMKRHEMIAKPPVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKHPVTLLHIR

SEQ ID NO: 10753 - protein, 412 aa, Homo sapiens
MGPLQFRDVAIEFSLEEWHCLDAAQRNLYRDVMLENYRNLIFLVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 10754 - protein, 368 aa, Homo sapiens [sequence omitted]

SEQ ID NO: 10755 - protein, 78 aa, Homo sapiens
MGPLQFRDVAIEFSLEEWHCLDAAQRNLYRDVMLENYRNLIFLGIVVSKPNLITCLEQGKKPLTMKRHEMIAKPPGGL

SEQ ID NO: 10756 - protein, 444 aa, Homo sapiens; identical to SEQ ID NO: 10751

SEQ ID NO: 10757 - protein, 220 aa, Homo sapiens; identical to SEQ ID NO: 10752

SEQ ID NO: 10758 - protein, 412 aa, Homo sapiens; identical to SEQ ID NO: 10753

SEQ ID NO: 10759 - protein, 108 aa, Homo sapiens
MGPLQFRDVAIEFSLEEWHCLDAAQRNLYRDVMLENYRNLIFLGIVVSKPNLITCLEQGKKPLTMKRHEMIAKPPGQARWLMPIIPALWRAKAGGSSEVRSSRKSGGP

SEQ ID NO: 10760 - protein, 368 aa, Homo sapiens [sequence omitted]

SEQ ID NO: 10761 - protein, 78 aa, Homo sapiens; identical to SEQ ID NO: 10755

SEQ ID NO: 10762 - protein, 628 aa, Homo sapiens
MALTQGPLKFMDVAIEFSQEEWKCLDPAQRTLYRDVMLENYRNLVSLGICLPDLSVTSMLEQKRDPWTLQSEEKIANDPDGRECIKGVNTERSSKLGSNAGNKPCKNQLGFTFQLHLSDLQLFQAERKISGCKHFEKPVSDNSSVSPLEKISSSVKSHLLNKYRNNFDHAPLLPQEQKAHIREKAYKCNEHGQVFRASASLTNQVIHNADNPYKCSECGKVFSCSSKLVIHRRMHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 10763 - protein, 761 aa, Homo sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 10764 - protein, 617 aa, Homo sapiens
MIKSQESLTLEDVAVEFTWEEWQLLGPAQKDLYRDVMLENYSNLVSVGYQASKPDALFKLEQGEPWTVENEIHSQICPEIKKVNNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 10765 - protein, 741 aa, Homo sapiens
MNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 10766 - protein, 86 aa, Homo sapiens
MLETYNSLVSLQELVSFEEVAVHFTWEEWQDLDDAQRTLYRDVMLETYSSLVSLGHYITKPEMIFKLEQGAEPWIVEETPNLRLSG

SEQ ID NO: 10767 - protein, 86 aa, Homo sapiens
MLETYNSLVSLQELVSFEEVAVHFTWEEWQDLDDAQRTLYRDVMLETYSSLVSLGHCITKPEMIFKLEQGAEPWIVEETLNLRLSG

SEQ ID NO: 10768 - protein, 989 aa, Homo sapiens
MEPPAAKRSRGCPAGPEERDAGAGAARGRGRPEALLDLSAKRVAESWAFEQVEERFSRVPEPVQKRIVFWSFPRSEREICMYSSLGYPPPEGEHDARVPFTRGLHLLQSGAVDRVLQVGFHLSGNIREPGSPGEPERLYHVSISFDRCKITSVSCGCDNRDLFYCAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGALWVCVVLSPHCKPEERAGWLQLLSRWDKLDVCPLEEGNYSFDGPSLQPTMAPAPELLQKGSTCITNTEGWVGHPLDPIGCLCRALLEACRLEEETLTLYPDSGPEKRKVAYQHVPVPGSPGESYLVLALEVALLGLGQQRALPEGLYAQDKVVRNEEQLLALLEEVELDERLVQVLRKQAGLLLEGGPFSGFGEVLFRESVPMHTCARYLFTALLPHDPDLAYRLALRAMRLPILETAFPAGEPHPSPLDSIMSNRFPRWFILGHLETRQCELASTMLTAAKGDPKWLHMVLGSIQQNIHSPALLFKLAQDACKTATPVSAPPDTTLLGIALELGLQVMRMTLNVMTWRRREMVRWLVSCATEIGPQALMNIMQNWYSLFTPVEAATIVAVTGTTHATLLRLQLDTSRREELWACARTLALQCAMKDPQNCALPALTLCEKNHSAFEAAYQIVLDAAAGGLGHAHLFTVARYMEHRGLPLRAYKLATLALAQLSIAFNQDSHPAVNDVLWACSLSHSLGRHELSAIVPLIIRSIHCAPMLSDILRRWTLSAPGLGPLGARRAAKPLGADRAPLCQLLDAAVTAYITTSHSRLTHISPRHYGDFIEFLGKARETFLLAPDGHLQFSQFLENLKQTYKGKKKLMLLVRERFG

SEQ ID NO: 10769 - protein, 487 aa, Homo sapiens
MSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 10770 - DNA, 17 bp, Homo sapiens
gatctgttcctggacgc

SEQ ID NO: 10771 - DNA, 17 bp, Homo sapiens
gatctctttcctgctta

SEQ ID NO: 10772 - DNA, 17 bp, Homo sapiens
gatcctgttttcaggtt

SEQ ID NO: 10773 - DNA, 17 bp, Homo sapiens
gatctagaagcaaagcc

SEQ ID NO: 10774 - DNA, 17 bp, Homo sapiens
gatcctgaccttcatgc

SEQ ID NO: 10775 - DNA, 17 bp, Homo sapiens
gatccaacaagaatctg

SEQ ID NO: 10776 - DNA, 17 bp, Homo sapiens
gatccggaggcctttgt

SEQ ID NO: 10777 - DNA, 17 bp, Homo sapiens
gatctccaggcctttgt

SEQ ID NO: 10778 - DNA, 17 bp, Homo sapiens
gatccctacttgaatgt

SEQ ID NO: 10779 - DNA, 17 bp, Homo sapiens
gatctagaagcctgggc

SEQ ID NO: 10780 - DNA, 17 bp, Homo sapiens
gatcagtagtatgtata

SEQ ID NO: 10781 - DNA, 17 bp, Homo sapiens
gatctcctttttctctg

SEQ ID NO: 10782 - DNA, 17 bp, Homo sapiens
gatcctccaaggagagg

SEQ ID NO: 10783 - DNA, 17 bp, Homo sapiens
gatcccctgacatatgg

SEQ ID NO: 10784 - DNA, 17 bp, Homo sapiens
gatccttatggctgtgt

SEQ ID NO: 10785 - DNA, 17 bp, Homo sapiens
gatccagccaccctgtc

SEQ ID NO: 10786 - DNA, 17 bp, Homo sapiens
gatcattggatgtatcc

SEQ ID NO: 10787 - DNA, 17 bp, Homo sapiens
gatcatggaaaactttt

SEQ ID NO: 10788 - DNA, 17 bp, Homo sapiens
gatccaggggagagata

SEQ ID NO: 10789 - DNA, 17 bp, Homo sapiens
gatctgctttcactaag

SEQ ID NO: 10790 - DNA, 17 bp, Homo sapiens
gatctcctctttggcct

SEQ ID NO: 10791 - DNA, 17 bp, Homo sapiens
gatccagggtttgagaa

SEQ ID NO: 10792 - DNA, 17 bp, Homo sapiens
gatctggaactgttatt

SEQ ID NO: 10793 - DNA, 17 bp, Homo sapiens
gatccccagggccaggg

SEQ ID NO: 10794 - DNA, 17 bp, Homo sapiens
gatctgcttccagaggt

SEQ ID NO: 10795 - DNA, 17 bp, Homo sapiens
gatcggagattgacagt

SEQ ID NO: 10796 - DNA, 17 bp, Homo sapiens
gatctaggcaggcaaag

SEQ ID NO: 10797 - DNA, 17 bp, Homo sapiens
gatccttcagggtttgg

SEQ ID NO: 10798 - DNA, 17 bp, Homo sapiens
gatcgatgtgttcgcat

SEQ ID NO: 10799 - DNA, 17 bp, Homo sapiens
gatctgaaaccctttgc

SEQ ID NO: 10800 - DNA, 17 bp, Homo sapiens
gatcatggtacatttat

SEQ ID NO: 10801 - DNA, 17 bp, Homo sapiens
gatcccttctttgcaaa

SEQ ID NO: 10802 - DNA, 17 bp, Homo sapiens
gatctgccaaagaggag

SEQ ID NO: 10803 - DNA, 17 bp, Homo sapiens
gatctccagataacact

SEQ ID NO: 10804 - DNA, 17 bp, Homo sapiens
gatctttacgtggtgta

SEQ ID NO: 10805 - DNA, 17 bp, Homo sapiens
gatcacctgggcctggg

SEQ ID NO: 10806 - DNA, 17 bp, Homo sapiens
gatcctcagaacctgca

SEQ ID NO: 10807 - DNA, 17 bp, Homo sapiens
gatcctccccgctcggc

SEQ ID NO: 10808 - DNA, 17 bp, Homo sapiens
gatcagccccagtagcc

SEQ ID NO: 10809 - DNA, 17 bp, Homo sapiens
gatcttgaatgagtgca

SEQ ID NO: 10810 - DNA, 17 bp, Homo sapiens
gatctgccggcgttggc

SEQ ID NO: 10811 - DNA, 17 bp, Homo sapiens
gatccttactgcagacc

SEQ ID NO: 10812 - DNA, 17 bp, Homo sapiens
gatctactctactcaca

SEQ ID NO: 10813 - DNA, 17 bp, Homo sapiens
gatcctattaggtgtaa

SEQ ID NO: 10814 - DNA, 17 bp, Homo sapiens
gatccgccaacaacagc

SEQ ID NO: 10815 - DNA, 17 bp, Homo sapiens
gatctactgcaggaggg

SEQ ID NO: 10816 - DNA, 17 bp, Homo sapiens
gatccggaaaccagaat

SEQ ID NO: 10817 - DNA, 17 bp, Homo sapiens
gatcacagtcccaaacc

SEQ ID NO: 10818 - DNA, 17 bp, Homo sapiens
gatcatttttgttcatt

SEQ ID NO: 10819 - DNA, 17 bp, Homo sapiens
gatccatcagaagcagc

SEQ ID NO: 10820 - DNA, 17 bp, Homo sapiens
gatctcgctgtgttgcc

SEQ ID NO: 10821 - DNA, 17 bp, Homo sapiens
gatccagcagcacgagg

SEQ ID NO: 10822 - DNA, 17 bp, Homo sapiens
gatcagaggcatttgga

SEQ ID NO: 10823 - DNA, 17 bp, Homo sapiens
gatcccagggacttgaa

SEQ ID NO: 10824 - DNA, 17 bp, Homo sapiens
gatcagcacatatttat

SEQ ID NO: 10825 - DNA, 17 bp, Homo sapiens
gatcttgctatgttacc

SEQ ID NO: 10826 - DNA, 17 bp, Homo sapiens
gatcaaatcagtggctt

SEQ ID NO: 10827 - DNA, 17 bp, Homo sapiens
gatcttgctttttgtgg

SEQ ID NO: 10828 - DNA, 17 bp, Homo sapiens
gatcatttgattccagg

SEQ ID NO: 10829 - DNA, 17 bp, Homo sapiens
gatcttactacttatat

SEQ ID NO: 10830 - DNA, 17 bp, Homo sapiens
gatccagactgtgaaga

SEQ ID NO: 10831 - DNA, 17 bp, Homo sapiens
gatctgtgggaggagca

SEQ ID NO: 10832 - DNA, 17 bp, Homo sapiens
gatcaggagattgaatt

SEQ ID NO: 10833 - DNA, 17 bp, Homo sapiens
gatcctgggaagatgct

SEQ ID NO: 10834 - DNA, 17 bp, Homo sapiens
gatcaactggaacaccc

SEQ ID NO: 10835 - DNA, 17 bp, Homo sapiens
gatcaaatcagagtgtg

SEQ ID NO: 10836 - DNA, 17 bp, Homo sapiens
gatcagggattgccaat

SEQ ID NO: 10837 - DNA, 17 bp, Homo sapiens
gatcttgttttcttctt

SEQ ID NO: 10838 - DNA, 17 bp, Homo sapiens
gatctagaatcaggctt

SEQ ID NO: 10839 - DNA, 17 bp, Homo sapiens
gatctcagagagtgaaa

SEQ ID NO: 10840 - DNA, 17 bp, Homo sapiens
gatcttactctgcttgg

SEQ ID NO: 10841 - DNA, 17 bp, Homo sapiens
gatcagaaaacattgct

SEQ ID NO: 10842 - DNA, 17 bp, Homo sapiens
gatccaccagtctcagc

SEQ ID NO: 10843 - DNA, 17 bp, Homo sapiens
gatccagctagagaaaa

SEQ ID NO: 10844 - DNA, 17 bp, Homo sapiens
gatcctctcacctcagg

SEQ ID NO: 10845 - DNA, 17 bp, Homo sapiens
gatcagtgcattgagca

SEQ ID NO: 10846 - DNA, 17 bp, Homo sapiens
gatccatacgctgatag

SEQ ID NO: 10847 - DNA, 17 bp, Homo sapiens
gatcccttgttacaaac

SEQ ID NO: 10848 - DNA, 17 bp, Homo sapiens
gatcagctctattcttt

SEQ ID NO: 10849 - DNA, 17 bp, Homo sapiens
gatcttaaacctttaat

SEQ ID NO: 10850 - DNA, 17 bp, Homo sapiens
gatccactgtcttataa

SEQ ID NO: 10851 - DNA, 17 bp, Homo sapiens
gatctgtttgggtgtaa

SEQ ID NO: 10852 - DNA, 17 bp, Homo sapiens
gatctttattttctaaa

SEQ ID NO: 10853 - DNA, 17 bp, Homo sapiens
gatctgagactcctcct

SEQ ID NO: 10854 - DNA, 17 bp, Homo sapiens
gatcagttcttcataag

SEQ ID NO: 10855 - DNA, 17 bp, Homo sapiens
gatctgcattggctaag

SEQ ID NO: 10856 - DNA, 17 bp, Homo sapiens
gatcattggtaaaatag

SEQ ID NO: 10857 - DNA, 17 bp, Homo sapiens
gatcacttgtgctaaga

SEQ ID NO: 10858 - DNA, 17 bp, Homo sapiens
gatccatgaagcttctt

SEQ ID NO: 10859 - DNA, 17 bp, Homo sapiens
gatctgtatggggcaat

SEQ ID NO: 10860 - DNA, 17 bp, Homo sapiens
gatcttttttttgtcct

SEQ ID NO: 10861 - DNA, 17 bp, Homo sapiens
gatcctgtatccatttg

SEQ ID NO: 10862 - DNA, 17 bp, Homo sapiens
gatctggccccacatgt

SEQ ID NO: 10863 - DNA, 17 bp, Homo sapiens
gatctgcagagaagatg

SEQ ID NO: 10864 - DNA, 17 bp, Homo sapiens
gatcctgctgactttgt

SEQ ID NO: 10865 - DNA, 17 bp, Homo sapiens
gatctcttttttgaaag

SEQ ID NO: 10866 - DNA, 17 bp, Homo sapiens
gatccttagtttttcag

SEQ ID NO: 10867 - DNA, 17 bp, Homo sapiens
gatcctaaaagactttg

SEQ ID NO: 10868 - DNA, 17 bp, Homo sapiens
gatccggacagggccct

SEQ ID NO: 10869 - DNA, 17 bp, Homo sapiens
gatcacctcggggcagg

SEQ ID NO: 10870 - DNA, 17 bp, Homo sapiens
gatcatgatacattaaa

SEQ ID NO: 10871 - DNA, 17 bp, Homo sapiens
gatctttagtcacttca

SEQ ID NO: 10872 - DNA, 17 bp, Homo sapiens
gatcattgataaatgtt

SEQ ID NO: 10873 - DNA, 17 bp, Homo sapiens
gatcgtaagcaccttta

SEQ ID NO: 10874 - DNA, 17 bp, Homo sapiens
gatcttgtttaactggc

SEQ ID NO: 10875 - DNA, 17 bp, Homo sapiens
gatccagagtcaacaga

SEQ ID NO: 10876 - DNA, 17 bp, Homo sapiens
gatctggtatttttgtg

SEQ ID NO: 10877 - DNA, 17 bp, Homo sapiens
gatctctcctccctgta

SEQ ID NO: 10878 - DNA, 17 bp, Homo sapiens
gatctccttcttccttt

SEQ ID NO: 10879 - DNA, 17 bp, Homo sapiens
gatcattttccttttcc

SEQ ID NO: 10880 - DNA, 17 bp, Homo sapiens
gatccccctggagagcc

SEQ ID NO: 10881 - DNA, 17 bp, Homo sapiens
gatcttgggtgtaacct

SEQ ID NO: 10882 - DNA, 17 bp, Homo sapiens
gatccttcataacttct

SEQ ID NO: 10883 - DNA, 17 bp, Homo sapiens
gatctggctactgcact

SEQ ID NO: 10884 - DNA, 17 bp, Homo sapiens
gatcacctttgcgaaca

SEQ ID NO: 10885 - DNA, 17 bp, Homo sapiens
gatcagaattctcattt

SEQ ID NO: 10886 - DNA, 17 bp, Homo sapiens
gatcatgctactaccct

SEQ ID NO: 10887 - DNA, 17 bp, Homo sapiens
gatctcagacaaaatca

SEQ ID NO: 10888 - DNA, 17 bp, Homo sapiens
gatcaactaaaaaaaaa

SEQ ID NO: 10889 - DNA, 17 bp, Homo sapiens
gatcttaaatatggcaa

SEQ ID NO: 10890 - DNA, 17 bp, Homo sapiens
gatcctactgcctcagt

SEQ ID NO: 10891 - DNA, 17 bp, Homo sapiens
gatccacttgaaatatt

SEQ ID NO: 10892 - DNA, 17 bp, Homo sapiens
gatcattgttctgaagt

SEQ ID NO: 10893 - DNA, 17 bp, Homo sapiens
gatcgcatggtgaaacc

SEQ ID NO: 10894 - DNA, 17 bp, Homo sapiens
gatctttcttaacatca

SEQ ID NO: 10895 - DNA, 17 bp, Homo sapiens
gatcacttgttcccagg

SEQ ID NO: 10896 - DNA, 17 bp, Homo sapiens
gatccctgggtatcact

SEQ ID NO: 10897 - DNA, 17 bp, Homo sapiens
gatctcctggggtcggg

SEQ ID NO: 10898 - DNA, 17 bp, Homo sapiens
gatcctgtgggtaaaca

SEQ ID NO: 10899 - DNA, 17 bp, Homo sapiens
gatcaaatttgagaatc

SEQ ID NO: 10900 - DNA, 17 bp, Homo sapiens
gatctaattccagtgct

SEQ ID NO: 10901 - DNA, 17 bp, Homo sapiens
gatcaacttctgaaatc

SEQ ID NO: 10902 - DNA, 17 bp, Homo sapiens
gatcccaatacagagag

SEQ ID NO: 10903 - DNA, 17 bp, Homo sapiens
gatcaggaacttggttg

SEQ ID NO: 10904 - DNA, 17 bp, Homo sapiens
gatcaccggacttaaca

SEQ ID NO: 10905 - DNA, 17 bp, Homo sapiens
gatctaacaaaaaaaca

SEQ ID NO: 10906 - DNA, 17 bp, Homo sapiens
gatctcactatattgtc

SEQ ID NO: 10907 - DNA, 17 bp, Homo sapiens
gatcaaaaaagcttagg

SEQ ID NO: 10908 - DNA, 17 bp, Homo sapiens
gatcaatttcattgcta

SEQ ID NO: 10909 - DNA, 17 bp, Homo sapiens
gatcgcactgctgctct

SEQ ID NO: 10910 - DNA, 17 bp, Homo sapiens
gatcaatcagcagccat

SEQ ID NO: 10911 - DNA, 17 bp, Homo sapiens
gatcagaacaaaaatat

SEQ ID NO: 10912 - DNA, 17 bp, Homo sapiens
gatcacacaacatacat

SEQ ID NO: 10913 - DNA, 17 bp, Homo sapiens
gatcgtgatagtggctg

SEQ ID NO: 10914 - DNA, 17 bp, Homo sapiens
gatcaaaccaacttaca

SEQ ID NO: 10915 - DNA, 17 bp, Homo sapiens
gatcagaatgaagatga

SEQ ID NO: 10916 - DNA, 17 bp, Homo sapiens
gatctcatagaagtgaa

SEQ ID NO: 10917 - DNA, 17 bp, Homo sapiens
gatcatcttaattgggt

SEQ ID NO: 10918 - DNA, 17 bp, Homo sapiens
gatcccagcaaccaggg

SEQ ID NO: 10919 - DNA, 17 bp, Homo sapiens
gatccagcccagtcccc

SEQ ID NO: 10920 - DNA, 17 bp, Homo sapiens
gatcctaaaacagtcat

SEQ ID NO: 10921 - DNA, 17 bp, Homo sapiens
gatcatttctaaagctt

SEQ ID NO: 10922 - DNA, 17 bp, Homo sapiens
gatcctacattaataag

SEQ ID NO: 10923 - DNA, 17 bp, Homo sapiens
gatcctgttcgtggcag

SEQ ID NO: 10924 - DNA, 17 bp, Homo sapiens
gatcaattgaattctaa

SEQ ID NO: 10925 - DNA, 17 bp, Homo sapiens
gatctgcacgtggaatc

SEQ ID NO: 10926 - DNA, 17 bp, Homo sapiens
gatctggggagggcttc

SEQ ID NO: 10927 - DNA, 17 bp, Homo sapiens
gatcctgagaagcagtg

SEQ ID NO: 10928 - DNA, 17 bp, Homo sapiens
gatcccgatgaaagagg

SEQ ID NO: 10929 - DNA, 17 bp, Homo sapiens
gatccagaccccaagtg

SEQ ID NO: 10930 - DNA, 17 bp, Homo sapiens
gatcttgcagtggtaaa

SEQ ID NO: 10931 - DNA, 17 bp, Homo sapiens
gatctggataatataag

SEQ ID NO: 10932 - DNA, 17 bp, Homo sapiens
gatctccccgcctcagc

SEQ ID NO: 10933 - DNA, 17 bp, Homo sapiens
gatcgtaaacttttaaa

SEQ ID NO: 10934 - DNA, 17 bp, Homo sapiens
gatcaggacattagaag

SEQ ID NO: 10935 - DNA, 17 bp, Homo sapiens
gatctgtgtctgagtcc

SEQ ID NO: 10936 - DNA, 17 bp, Homo sapiens
gatctggagtgaccttt

SEQ ID NO: 10937 - DNA, 17 bp, Homo sapiens
gatcctcctgcctccag

SEQ ID NO: 10938 - DNA, 17 bp, Homo sapiens
gatctggtttcatcact

SEQ ID NO: 10939 - DNA, 17 bp, Homo sapiens
gatcacctctcaatttt

SEQ ID NO: 10940 - DNA, 17 bp, Homo sapiens
gatcagcagttaatttt

SEQ ID NO: 10941 - DNA, 17 bp, Homo sapiens
gatcccttatgaatgtc

SEQ ID NO: 10942 - DNA, 17 bp, Homo sapiens
gatctagattatctgga

SEQ ID NO: 10943 - DNA, 17 bp, Homo sapiens
gatctacttgctctaag

SEQ ID NO: 10944 - DNA, 17 bp, Homo sapiens
gatcctttcttctgatt

SEQ ID NO: 10945 - DNA, 17 bp, Homo sapiens
gatcaacacaggataac

SEQ ID NO: 10946 - DNA, 17 bp, Homo sapiens
gatcagaggctctggtt

SEQ ID NO: 10947 - DNA, 17 bp, Homo sapiens
gatcagcctgaccggcg

SEQ ID NO: 10948 - DNA, 17 bp, Homo sapiens
gatctcagggtacaagt

SEQ ID NO: 10949 - DNA, 17 bp, Homo sapiens
gatcttccctcctaaac

SEQ ID NO: 10950 - DNA, 17 bp, Homo sapiens
gatctttaaaacattcc

SEQ ID NO: 10951 - DNA, 17 bp, Homo sapiens
gatcccacagccccgcc

SEQ ID NO: 10952 - DNA, 17 bp, Homo sapiens
gatcaacattgtaagtt

SEQ ID NO: 10953 - DNA, 17 bp, Homo sapiens
gatccaggtgggaggag

SEQ ID NO: 10954 - DNA, 17 bp, Homo sapiens
gatcttctactgcctcc

SEQ ID NO: 10955 - DNA, 17 bp, Homo sapiens
gatcgcccagaaggaga

SEQ ID NO: 10956 - DNA, 17 bp, Homo sapiens
gatccagaagaccttga

SEQ ID NO: 10957 - DNA, 17 bp, Homo sapiens
gatctcttcaacagggc

SEQ ID NO: 10958 - DNA, 17 bp, Homo sapiens
gatctgcagagacagct

SEQ ID NO: 10959 - DNA, 17 bp, Homo sapiens
gatctttgagttggaaa

SEQ ID NO: 10960 - DNA, 17 bp, Homo sapiens
gatcagtgttaagtgca

SEQ ID NO: 10961 - DNA, 17 bp, Homo sapiens
gatctaaagccagttgg

SEQ ID NO: 10962 - DNA, 17 bp, Homo sapiens
gatccaattgtcctccc

SEQ ID NO: 10963 - DNA, 17 bp, Homo sapiens
gatccttccctaaagta

SEQ ID NO: 10964 - DNA, 17 bp, Homo sapiens
gatctaaacagcaccag

SEQ ID NO: 10965 - DNA, 17 bp, Homo sapiens
gatcccctgactattca

SEQ ID NO: 10966 - DNA, 17 bp, Homo sapiens
gatcaaaaaatttatca

SEQ ID NO: 10967 - DNA, 17 bp, Homo sapiens
gatccgccaatcctctg

SEQ ID NO: 10968 - DNA, 17 bp, Homo sapiens
gatccactcggggatgg

SEQ ID NO: 10969 - DNA, 17 bp, Homo sapiens
gatctggtgtgagtagt

SEQ ID NO: 10970 - DNA, 17 bp, Homo sapiens
gatctgcccgctttgac

SEQ ID NO: 10971 - DNA, 17 bp, Homo sapiens
gatcctgttgcatcccc

SEQ ID NO: 10972 - DNA, 17 bp, Homo sapiens
gatcacaacttgatttt

SEQ ID NO: 10973 - DNA, 17 bp, Homo sapiens
gatctataattggcaga

SEQ ID NO: 10974 - DNA, 17 bp, Homo sapiens
gatccttggctgtggaa

SEQ ID NO: 10975 - DNA, 17 bp, Homo sapiens
gatcaccctgaggccag

SEQ ID NO: 10976 - DNA, 17 bp, Homo sapiens
gatcccttgctttggga

SEQ ID NO: 10977 - DNA, 17 bp, Homo sapiens
gatctgagactcaggaa

SEQ ID NO: 10978 - DNA, 17 bp, Homo sapiens
gatctgcagggcccaga

SEQ ID NO: 10979 - DNA, 17 bp, Homo sapiens
gatcccactggccacat

SEQ ID NO: 10980 - DNA, 17 bp, Homo sapiens
gatcaacaaagacctgt

SEQ ID NO: 10981 - DNA, 17 bp, Homo sapiens
gatcagcagctggtcgc

SEQ ID NO: 10982 - DNA, 17 bp, Homo sapiens
gatcaaaagccactgca

SEQ ID NO: 10983 - DNA, 17 bp, Homo sapiens
gatcccatctcccagct

SEQ ID NO: 10984 - DNA, 17 bp, Homo sapiens
gatcaaacaggagggag

SEQ ID NO: 10985 - DNA, 17 bp, Homo sapiens
gatcctccttcctcagt

SEQ ID NO: 10986 - DNA, 17 bp, Homo sapiens
gatcttaaagaacagaa

SEQ ID NO: 10987 - DNA, 17 bp, Homo sapiens
gatccagaccctcgtag

SEQ ID NO: 10988 - DNA, 17 bp, Homo sapiens
gatccattagcttttat

SEQ ID NO: 10989 - DNA, 17 bp, Homo sapiens
gatccgtgaattctcgg

SEQ ID NO: 10990 - DNA, 17 bp, Homo sapiens
gatcaaggtcaaataat

SEQ ID NO: 10991 - DNA, 17 bp, Homo sapiens
gatccccatagaaacat

SEQ ID NO: 10992 - DNA, 17 bp, Homo sapiens
gatctctctgctcagga

SEQ ID NO: 10993 - DNA, 17 bp, Homo sapiens
gatcataatggaataaa

SEQ ID NO: 10994 - DNA, 17 bp, Homo sapiens
gatccacgcccgctaca

SEQ ID NO: 10995 - DNA, 17 bp, Homo sapiens
gatcctcttggcaggtg

SEQ ID NO: 10996 - DNA, 17 bp, Homo sapiens
gatccttctgcttggcc

SEQ ID NO: 10997 - DNA, 17 bp, Homo sapiens
gatcttttttaaaaaag

SEQ ID NO: 10998 - DNA, 17 bp, Homo sapiens
gatctcatctcatctta

SEQ ID NO: 10999 - DNA, 17 bp, Homo sapiens
gatcactatttagaaaa

SEQ ID NO: 11000 - DNA, 17 bp, Homo sapiens
gatcacaggcttgagcc

SEQ ID NO: 11001 - DNA, 17 bp, Homo sapiens
gatccagacagcccact

SEQ ID NO: 11002 - DNA, 17 bp, Homo sapiens
gatcgctggagtccagg

SEQ ID NO: 11003 - DNA, 17 bp, Homo sapiens
gatcaccggctattact

SEQ ID NO: 11004 - DNA, 17 bp, Homo sapiens
gatccccctagaagtct

SEQ ID NO: 11005 - DNA, 17 bp, Homo sapiens
gatctcagaactataat

SEQ ID NO: 11006 - DNA, 17 bp, Homo sapiens
gatccagtccctggaga

SEQ ID NO: 11007 - DNA, 17 bp, Homo sapiens
gatccaactccaatccg

SEQ ID NO: 11008 - DNA, 17 bp, Homo sapiens
gatcttcctgcccaagc

SEQ ID NO: 11009 - DNA, 17 bp, Homo sapiens
gatcctaggtgtcctct

SEQ ID NO: 11010 - DNA, 17 bp, Homo sapiens
gatcccagtggtcaggg

SEQ ID NO: 11011 - DNA, 17 bp, Homo sapiens
gatcctgggatgggcag

SEQ ID NO: 11012 - DNA, 17 bp, Homo sapiens
gatcaaaaatatccggg

SEQ ID NO: 11013 - DNA, 17 bp, Homo sapiens
gatctgaacctcatctg

SEQ ID NO: 11014 - DNA, 17 bp, Homo sapiens
gatctatctattctgct

SEQ ID NO: 11015 - DNA, 17 bp, Homo sapiens
gatcatgacgaataaaa

SEQ ID NO: 11016 - DNA, 17 bp, Homo sapiens
gatccacgagacaacca

SEQ ID NO: 11017 - DNA, 17 bp, Homo sapiens
gatcaaaaagttttgca

SEQ ID NO: 11018 - DNA, 17 bp, Homo sapiens
gatccaagagagctaca

SEQ ID NO: 11019 - DNA, 17 bp, Homo sapiens
gatcgggtatcttcctg

SEQ ID NO: 11020 - DNA, 17 bp, Homo sapiens
gatcaaagactcaactt

SEQ ID NO: 11021 - DNA, 17 bp, Homo sapiens
gatcctggtgctgggtt

SEQ ID NO: 11022 - DNA, 17 bp, Homo sapiens
gatctatgcagacctcc

SEQ ID NO: 11023 - DNA, 17 bp, Homo sapiens
gatcccagacgggctca

SEQ ID NO: 11024 - DNA, 17 bp, Homo sapiens
gatcgctggagcccggg

SEQ ID NO: 11025 - DNA, 17 bp, Homo sapiens
gatcagcctgaccaccg

SEQ ID NO: 11026 - DNA, 17 bp, Homo sapiens
gatctctgtcaaatgca

SEQ ID NO: 11027 - DNA, 17 bp, Homo sapiens
gatccgatgatgctgta

SEQ ID NO: 11028 - DNA, 17 bp, Homo sapiens
gatccgggtcaggaaaa

SEQ ID NO: 11029 - DNA, 17 bp, Homo sapiens
gatccctatctctgacc

SEQ ID NO: 11030 - DNA, 17 bp, Homo sapiens
gatctctttgaaaaaat

SEQ ID NO: 11031 - DNA, 17 bp, Homo sapiens
gatcctggcatatctca

SEQ ID NO: 11032 - DNA, 17 bp, Homo sapiens
gatcctcccctggtgaa

SEQ ID NO: 11033 - DNA, 17 bp, Homo sapiens
gatctaataagctttat

SEQ ID NO: 11034 - DNA, 17 bp, Homo sapiens
gatcagctcaactgatt

SEQ ID NO: 11035 - DNA, 17 bp, Homo sapiens
gatcctaaactgctttt

SEQ ID NO: 11036 - DNA, 17 bp, Homo sapiens
gatcaatattctactgg

SEQ ID NO: 11037 - DNA, 17 bp, Homo sapiens
gatccttgttttgcaat

SEQ ID NO: 11038 - DNA, 17 bp, Homo sapiens
gatctcatgtggtggaa

SEQ ID NO: 11039 - DNA, 17 bp, Homo sapiens
gatcacagtcactgcca

SEQ ID NO: 11040 - DNA, 17 bp, Homo sapiens
gatcctgctgtgttgaa

SEQ ID NO: 11041 - DNA, 17 bp, Homo sapiens
gatccagcctcacaagt

SEQ ID NO: 11042 - DNA, 17 bp, Homo sapiens
gatcctttcctccgccc

SEQ ID NO: 11043 - DNA, 17 bp, Homo sapiens
gatcttttttcccttgc

SEQ ID NO: 11044 - DNA, 17 bp, Homo sapiens
gatcagtgttataagcc

SEQ ID NO: 11045 - DNA, 17 bp, Homo sapiens
gatcactacagcctcga

SEQ ID NO: 11046 - DNA, 17 bp, Homo sapiens
gatcctgccgcctgtcc

SEQ ID NO: 11047 - DNA, 17 bp, Homo sapiens
gatctgatgtttctgcc

SEQ ID NO: 11048 - DNA, 17 bp, Homo sapiens
gatcatcagcatttaca

SEQ ID NO: 11049 - DNA, 17 bp, Homo sapiens
gatcaggtgttcccaac

SEQ ID NO: 11050 - DNA, 17 bp, Homo sapiens
gatctctcagcctaaaa

SEQ ID NO: 11051 - DNA, 17 bp, Homo sapiens
gatctgatttgtaaatt

SEQ ID NO: 11052 - DNA, 17 bp, Homo sapiens
gatcaatagttctgaat

SEQ ID NO: 11053 - DNA, 17 bp, Homo sapiens
gatctgccccctggagg

SEQ ID NO: 11054 - DNA, 17 bp, Homo sapiens
gatctagctagcattcc

SEQ ID NO: 11055 - DNA, 17 bp, Homo sapiens
gatcatagaattctctc

SEQ ID NO: 11056 - DNA, 17 bp, Homo sapiens
gatctgtaatcaattaa

SEQ ID NO: 11057 - DNA, 17 bp, Homo sapiens
gatctacaatagatgtc

SEQ ID NO: 11058 - DNA, 17 bp, Homo sapiens
gatcctgtttctcccaa

SEQ ID NO: 11059 - DNA, 17 bp, Homo sapiens
gatcacttgtgcctagg

SEQ ID NO: 11060 - DNA, 17 bp, Homo sapiens
gatcagtctaaaaactg

SEQ ID NO: 11061 - DNA, 17 bp, Homo sapiens
gatccatcagttcttca

SEQ ID NO: 11062 - DNA, 17 bp, Homo sapiens
gatctagtggacttggt

SEQ ID NO: 11063 - DNA, 17 bp, Homo sapiens
gatcctcaaaaacagcc

SEQ ID NO: 11064 - DNA, 17 bp, Homo sapiens
gatccaatccagaacct

SEQ ID NO: 11065 - DNA, 17 bp, Homo sapiens
gatcctccctcctccca

SEQ ID NO: 11066 - DNA, 17 bp, Homo sapiens
gatctgcagctggatac

SEQ ID NO: 11067 - DNA, 17 bp, Homo sapiens
gatcttctttgccaaaa

SEQ ID NO: 11068 - DNA, 17 bp, Homo sapiens
gatcagctctgtgaaga

SEQ ID NO: 11069 - DNA, 17 bp, Homo sapiens
gatctctgcttttgctt

SEQ ID NO: 11070 - DNA, 17 bp, Homo sapiens
gatcccagaagataaac

SEQ ID NO: 11071 - DNA, 17 bp, Homo sapiens
gatcttttttgtatttt

SEQ ID NO: 11072 - DNA, 17 bp, Homo sapiens
gatccagggcactgaga

SEQ ID NO: 11073 - DNA, 17 bp, Homo sapiens
gatcatgtcagttcagt

SEQ ID NO: 11074 - DNA, 17 bp, Homo sapiens
gatcctttacaccttct

SEQ ID NO: 11075 - DNA, 17 bp, Homo sapiens
gatcggaaagctgggca

SEQ ID NO: 11076 - DNA, 17 bp, Homo sapiens
gatctctcatgcatttt

SEQ ID NO: 11077 - DNA, 17 bp, Homo sapiens
gatcagtttgcacaagc

SEQ ID NO: 11078 - DNA, 17 bp, Homo sapiens
gatccgaaataaacatc

SEQ ID NO: 11079 - DNA, 17 bp, Homo sapiens
gatctgcctccatccat

SEQ ID NO: 11080 - DNA, 17 bp, Homo sapiens
gatcgggaccgtgggcg

SEQ ID NO: 11081 - DNA, 17 bp, Homo sapiens
gatcctgcgtcagagtt

SEQ ID NO: 11082 - DNA, 17 bp, Homo sapiens
gatctaccagttgtcca

SEQ ID NO: 11083 - DNA, 17 bp, Homo sapiens
gatcctaaaacagactt

SEQ ID NO: 11084 - DNA, 17 bp, Homo sapiens
gatcttatttttttatt

SEQ ID NO: 11085 - DNA, 17 bp, Homo sapiens
gatccagaatgtcaaag

SEQ ID NO: 11086 - DNA, 17 bp, Homo sapiens
gatccccagcccagggc

SEQ ID NO: 11087 - DNA, 17 bp, Homo sapiens
gatcctcacataaaatg

SEQ ID NO: 11088 - DNA, 17 bp, Homo sapiens
gatccctggctgctgct

SEQ ID NO: 11089 - DNA, 17 bp, Homo sapiens
gatcatcttcacctcaa

SEQ ID NO: 11090 - DNA, 17 bp, Homo sapiens
gatcgcagcaattctga

SEQ ID NO: 11091 - DNA, 17 bp, Homo sapiens
gatcagattttagtaat

SEQ ID NO: 11092 - DNA, 17 bp, Homo sapiens
gatctgatttagttatg

SEQ ID NO: 11093 - DNA, 17 bp, Homo sapiens
gatctactcgctcacac

SEQ ID NO: 11094 - DNA, 17 bp, Homo sapiens
gatcttaggcaagttac

SEQ ID NO: 11095 - DNA, 17 bp, Homo sapiens
gatccatacatactata

SEQ ID NO: 11096 - DNA, 17 bp, Homo sapiens
gatcacttctgagtcct

SEQ ID NO: 11097 - DNA, 17 bp, Homo sapiens
gatcttctttcttcaag

SEQ ID NO: 11098 - DNA, 17 bp, Homo sapiens
gatcatacagtgtgtag

SEQ ID NO: 11099 - DNA, 17 bp, Homo sapiens
gatctttacttcttcca

SEQ ID NO: 11100 - DNA, 17 bp, Homo sapiens
gatcctggctaatgcag

SEQ ID NO: 11101 - DNA, 17 bp, Homo sapiens
gatccgtgttcgtgtgg

SEQ ID NO: 11102 - DNA, 17 bp, Homo sapiens
gatcctagaggagcaga

SEQ ID NO: 11103 - DNA, 17 bp, Homo sapiens
gatcctgtgggcgttcc

SEQ ID NO: 11104 - DNA, 17 bp, Homo sapiens
gatccatgccaccccac

SEQ ID NO: 11105 - DNA, 17 bp, Homo sapiens
gatcgcgccactgtgcc

SEQ ID NO: 11106 - DNA, 17 bp, Homo sapiens
gatcctgagatattcaa

SEQ ID NO: 11107 - DNA, 17 bp, Homo sapiens
gatcattaattagaagg

SEQ ID NO: 11108 - DNA, 17 bp, Homo sapiens
gatcctcctgcctggac

SEQ ID NO: 11109 - DNA, 17 bp, Homo sapiens
gatcacacaggtgccaa

SEQ ID NO: 11110 - DNA, 17 bp, Homo sapiens
gatcctgtgaaaattaa

SEQ ID NO: 11111 - DNA, 17 bp, Homo sapiens
gatccggaagaacttta

SEQ ID NO: 11112 - DNA, 17 bp, Homo sapiens
gatccctgaattctcta

SEQ ID NO: 11113 - DNA, 17 bp, Homo sapiens
gatctggccatcccgct

SEQ ID NO: 11114 - DNA, 17 bp, Homo sapiens
gatccaggcttcattcc

SEQ ID NO: 11115 - DNA, 17 bp, Homo sapiens
gatccatatcatttttt

SEQ ID NO: 11116 - DNA, 17 bp, Homo sapiens
gatcattctagcctcaa

SEQ ID NO: 11117 - DNA, 17 bp, Homo sapiens
gatcagctcttcggcag

SEQ ID NO: 11118 - DNA, 17 bp, Homo sapiens
gatcagtatggcgattt

SEQ ID NO: 11119 - DNA, 17 bp, Homo sapiens
gatccccagaagcgatg

SEQ ID NO: 11120 - DNA, 17 bp, Homo sapiens
gatctgtttgtctaacc

SEQ ID NO: 11121 - DNA, 17 bp, Homo sapiens
gatccagccccaggccc

SEQ ID NO: 11122 - DNA, 17 bp, Homo sapiens
gatcatcttcaaacaaa

SEQ ID NO: 11123 - DNA, 17 bp, Homo sapiens
gatcacagtttgtttac

SEQ ID NO: 11124 - DNA, 17 bp, Homo sapiens
gatcctggctttacaca

SEQ ID NO: 11125 - DNA, 17 bp, Homo sapiens
gatctcatgaagcagag

SEQ ID NO: 11126 - DNA, 17 bp, Homo sapiens
gatctcttgttctcctg

SEQ ID NO: 11127 - DNA, 17 bp, Homo sapiens
gatcatgagagctatgg

SEQ ID NO: 11128 - DNA, 17 bp, Homo sapiens
gatctttgcgagaatgc

SEQ ID NO: 11129 - DNA, 17 bp, Homo sapiens
gatctccctcagtctgc

SEQ ID NO: 11130 - DNA, 17 bp, Homo sapiens
gatctactcacctcggc

SEQ ID NO: 11131 - DNA, 17 bp, Homo sapiens
gatctatttattctaaa

SEQ ID NO: 11132 - DNA, 17 bp, Homo sapiens
gatccacaggcaaattt

SEQ ID NO: 11133 - DNA, 17 bp, Homo sapiens
gatccagcctgtgccaa

SEQ ID NO: 11134 - DNA, 17 bp, Homo sapiens
gatcactgtggctggaa

SEQ ID NO: 11135 - DNA, 17 bp, Homo sapiens
gatcctcaccgagaaga

SEQ ID NO: 11136 - DNA, 17 bp, Homo sapiens
gatctgcccaccttatc

SEQ ID NO: 11137 - DNA, 17 bp, Homo sapiens
gatctctaattttctct

SEQ ID NO: 11138 - DNA, 17 bp, Homo sapiens
gatctgttgaagtagta

SEQ ID NO: 11139 - DNA, 17 bp, Homo sapiens
gatctcatctctataaa

SEQ ID NO: 11140 - DNA, 17 bp, Homo sapiens
gatcctgagggacagag

SEQ ID NO: 11141 - DNA, 17 bp, Homo sapiens
gatccctgtcttggcac

SEQ ID NO: 11142 - DNA, 17 bp, Homo sapiens
gatctggtccaatggca

SEQ ID NO: 11143 - DNA, 17 bp, Homo sapiens
gatccagcagctgcttc

SEQ ID NO: 11144 - DNA, 17 bp, Homo sapiens
gatcaaattagacacaa

SEQ ID NO: 11145 - DNA, 17 bp, Homo sapiens
gatccactttctgtctc

SEQ ID NO: 11146 - DNA, 17 bp, Homo sapiens
gatctttacacatatcg

SEQ ID NO: 11147 - DNA, 17 bp, Homo sapiens
gatcacctgaagccagc

SEQ ID NO: 11148 - DNA, 17 bp, Homo sapiens
gatccgagatgtgggca

SEQ ID NO: 11149 - DNA, 17 bp, Homo sapiens
gatccctctgtaagtcg

SEQ ID NO: 11150 - DNA, 17 bp, Homo sapiens
gatccattggcattata

SEQ ID NO: 11151 - DNA, 17 bp, Homo sapiens
gatctgatttcctcttt

SEQ ID NO: 11152 - DNA, 17 bp, Homo sapiens
gatcagcaaaactaaga

SEQ ID NO: 11153 - DNA, 17 bp, Homo sapiens
gatctttgttaaatgcc

SEQ ID NO: 11154 - DNA, 17 bp, Homo sapiens
gatctgtctgcctgttc

SEQ ID NO: 11155 - DNA, 17 bp, Homo sapiens
gatcactcaactgcatt

SEQ ID NO: 11156 - DNA, 17 bp, Homo sapiens
gatcttttccatctcta

SEQ ID NO: 11157 - DNA, 17 bp, Homo sapiens
gatccccaagtcctcgt

SEQ ID NO: 11158 - DNA, 17 bp, Homo sapiens
gatccttttcaagacca

SEQ ID NO: 11159 - DNA, 17 bp, Homo sapiens
gatctataattacatgt

SEQ ID NO: 11160 - DNA, 17 bp, Homo sapiens
gatctgccagcctccgc

SEQ ID NO: 11161 - DNA, 17 bp, Homo sapiens
gatcaaattttctgctt

SEQ ID NO: 11162 - DNA, 17 bp, Homo sapiens
gatcattatcctggtgg

SEQ ID NO: 11163 - DNA, 17 bp, Homo sapiens
gatcccctgtctatcct

SEQ ID NO: 11164 - DNA, 17 bp, Homo sapiens
gatctctttgaccttat

SEQ ID NO: 11165 - DNA, 17 bp, Homo sapiens
gatcatctgtacactct

SEQ ID NO: 11166 - DNA, 17 bp, Homo sapiens
gatcagcagaatccagc

SEQ ID NO: 11167 - DNA, 17 bp, Homo sapiens
gatcatggaaacacaac

SEQ ID NO: 11168 - DNA, 17 bp, Homo sapiens
gatctgggttgagttcc

SEQ ID NO: 11169 - DNA, 17 bp, Homo sapiens
gatcacatgggccaagt

SEQ ID NO: 11170 - DNA, 17 bp, Homo sapiens
gatccacaactttgtag

SEQ ID NO: 11171 - DNA, 17 bp, Homo sapiens
gatctgtttttctgcct

SEQ ID NO: 11172 - DNA, 17 bp, Homo sapiens
gatcatttcaccactgg

SEQ ID NO: 11173 - DNA, 17 bp, Homo sapiens
gatccaccacgccccac

SEQ ID NO: 11174 - DNA, 17 bp, Homo sapiens
gatctcatctggtattc

SEQ ID NO: 11175 - DNA, 17 bp, Homo sapiens
gatcctcggggaactgg

SEQ ID NO: 11176 - DNA, 17 bp, Homo sapiens
gatcaaccgtgttatga

SEQ ID NO: 11177 - DNA, 17 bp, Homo sapiens
gatcatctggctcctga

SEQ ID NO: 11178 - DNA, 17 bp, Homo sapiens
gatcctcccattagctg

SEQ ID NO: 11179 - DNA, 17 bp, Homo sapiens
gatcttttttcctttac

SEQ ID NO: 11180 - DNA, 17 bp, Homo sapiens
gatctggcttctcccca

SEQ ID NO: 11181 - DNA, 17 bp, Homo sapiens
gatcctaccccatcaga

SEQ ID NO: 11182 - DNA, 17 bp, Homo sapiens
gatctttaatcttgaaa

SEQ ID NO: 11183 - DNA, 17 bp, Homo sapiens
gatcttaagtgtatttt

SEQ ID NO: 11184 - DNA, 17 bp, Homo sapiens
gatctcattggtttcct

SEQ ID NO: 11185 - DNA, 17 bp, Homo sapiens
gatctgctgaccttccc

SEQ ID NO: 11186 - DNA, 17 bp, Homo sapiens
gatccatcccaccttgg

SEQ ID NO: 11187 - DNA, 17 bp, Homo sapiens
gatctgaggctcagaaa

SEQ ID NO: 11188 - DNA, 17 bp, Homo sapiens
gatctttctttctcctt

SEQ ID NO: 11189 - DNA, 17 bp, Homo sapiens
gatccaggtccccacct

SEQ ID NO: 11190 - DNA, 17 bp, Homo sapiens
gatccactttgcctggg

SEQ ID NO: 11191 - DNA, 17 bp, Homo sapiens
gatccaagcccaacagg

SEQ ID NO: 11192 - DNA, 17 bp, Homo sapiens
gatctctttaggttttt

SEQ ID NO: 11193 - DNA, 17 bp, Homo sapiens
gatctcctttggggtct

SEQ ID NO: 11194 - DNA, 17 bp, Homo sapiens
gatcaagcaagaatcct

SEQ ID NO: 11195 - DNA, 17 bp, Homo sapiens
gatctggatattgttgg

SEQ ID NO: 11196 - DNA, 17 bp, Homo sapiens
gatctgtcttggagaaa

SEQ ID NO: 11197 - DNA, 17 bp, Homo sapiens
gatcttgacctgaatcc

SEQ ID NO: 11198 - DNA, 17 bp, Homo sapiens
gatctgagaggttgagc

SEQ ID NO: 11199 - DNA, 17 bp, Homo sapiens
gatcattctgcaatcta

SEQ ID NO: 11200 - DNA, 17 bp, Homo sapiens
gatccagcctagaacaa

SEQ ID NO: 11201 - DNA, 17 bp, Homo sapiens
gatcgcacatatacaag

SEQ ID NO: 11202 - DNA, 17 bp, Homo sapiens
gatccaaaataaaccca

SEQ ID NO: 11203 - DNA, 17 bp, Homo sapiens
gatctacaactttgtgg

SEQ ID NO: 11204 - DNA, 17 bp, Homo sapiens
gatccagagtaagtgcc

SEQ ID NO: 11205 - DNA, 17 bp, Homo sapiens
gatccttgttctgatga

SEQ ID NO: 11206 - DNA, 17 bp, Homo sapiens
gatcattttctgtcagt

SEQ ID NO: 11207 - DNA, 17 bp, Homo sapiens
gatctttctaaagagaa

SEQ ID NO: 11208 - DNA, 17 bp, Homo sapiens
gatctagagcaaagagt

SEQ ID NO: 11209 - DNA, 17 bp, Homo sapiens
gatcctcagaacagcct

SEQ ID NO: 11210 - DNA, 17 bp, Homo sapiens
gatcctgaaggcccgag

SEQ ID NO: 11211 - DNA, 17 bp, Homo sapiens
gatcctggcccagaaaa

SEQ ID NO: 11212 - DNA, 17 bp, Homo sapiens
gatcagctacctcactc

SEQ ID NO: 11213 - DNA, 17 bp, Homo sapiens
gatcctggtatgttccc

SEQ ID NO: 11214 - DNA, 17 bp, Homo sapiens
gatccctcatataataa

SEQ ID NO: 11215 - DNA, 17 bp, Homo sapiens
gatccttacatattata

SEQ ID NO: 11216 - DNA, 17 bp, Homo sapiens
gatcatattaatacagt

SEQ ID NO: 11217 - DNA, 17 bp, Homo sapiens
gatccaaaagagtgatg

SEQ ID NO: 11218 - DNA, 17 bp, Homo sapiens
gatcatttgttttcttc

SEQ ID NO: 11219 - DNA, 17 bp, Homo sapiens
gatcgttcatttcacag

SEQ ID NO: 11220 - DNA, 17 bp, Homo sapiens
gatctccttgctgtccc

SEQ ID NO: 11221 - DNA, 17 bp, Homo sapiens
gatctaatttacatggt

SEQ ID NO: 11222 - DNA, 17 bp, Homo sapiens
gatcaagcaatcctctc

SEQ ID NO: 11223 - DNA, 17 bp, Homo sapiens
gatcgttactgtaggca

SEQ ID NO: 11224 - DNA, 17 bp, Homo sapiens
gatctttcctaaagtcc

SEQ ID NO: 11225 - DNA, 17 bp, Homo sapiens
gatcccttgaacttctt

SEQ ID NO: 11226 - DNA, 17 bp, Homo sapiens
gatctggtcaaagagaa

SEQ ID NO: 11227 - DNA, 17 bp, Homo sapiens
gatctcagcaaccagca

SEQ ID NO: 11228 - DNA, 17 bp, Homo sapiens
gatcaggtcttttcagg

SEQ ID NO: 11229 - DNA, 17 bp, Homo sapiens
gatcaacacacagctaa

SEQ ID NO: 11230 - DNA, 17 bp, Homo sapiens
gatctggagcggcagct

SEQ ID NO: 11231 - DNA, 17 bp, Homo sapiens
gatcacagtgtgttgtt

SEQ ID NO: 11232 - DNA, 17 bp, Homo sapiens
gatctcgctatgttacc

SEQ ID NO: 11233 - DNA, 17 bp, Homo sapiens
gatcatgtttgttcatt

SEQ ID NO: 11234 - DNA, 17 bp, Homo sapiens
gatctttatgtcttcac

SEQ ID NO: 11235 - DNA, 17 bp, Homo sapiens
gatctttcttctttcac

SEQ ID NO: 11236 - DNA, 17 bp, Homo sapiens
gatccaatttcctcata

SEQ ID NO: 11237 - DNA, 17 bp, Homo sapiens
gatcaaaaagaaaagaa

SEQ ID NO: 11238 - DNA, 17 bp, Homo sapiens
gatctaaaaaaaaaacc

SEQ ID NO: 11239 - DNA, 17 bp, Homo sapiens
gatcttccttcttgata

SEQ ID NO: 11240 - DNA, 17 bp, Homo sapiens
gatctgatgtgcctgga

SEQ ID NO: 11241 - DNA, 17 bp, Homo sapiens
gatcatggtgcttggtc

SEQ ID NO: 11242 - DNA, 17 bp, Homo sapiens
gatcaggaaccagacaa

SEQ ID NO: 11243 - DNA, 17 bp, Homo sapiens
gatccttgtcaccttgt

SEQ ID NO: 11244 - DNA, 17 bp, Homo sapiens
gatcaatatttggacaa

SEQ ID NO: 11245 - DNA, 17 bp, Homo sapiens
gatcagaaagtagcata

SEQ ID NO: 11246 - DNA, 17 bp, Homo sapiens
gatcgcaccacatctct

SEQ ID NO: 11247 - DNA, 17 bp, Homo sapiens
gatccctcaaactattg

SEQ ID NO: 11248 - DNA, 17 bp, Homo sapiens
gatcagtgtttttcata

SEQ ID NO: 11249 - DNA, 17 bp, Homo sapiens
gatccataggctataat

SEQ ID NO: 11250 - DNA, 17 bp, Homo sapiens
gatcacgacacagctct

SEQ ID NO: 11251 - DNA, 17 bp, Homo sapiens
gatcccagtgatggcct

SEQ ID NO: 11252 - DNA, 17 bp, Homo sapiens
gatctcattgaacagaa

SEQ ID NO: 11253 - DNA, 17 bp, Homo sapiens
gatccctttggcagtgc

SEQ ID NO: 11254 - DNA, 17 bp, Homo sapiens
gatcaccactcggagtt

SEQ ID NO: 11255 - DNA, 17 bp, Homo sapiens
gatcttttaaattattc

SEQ ID NO: 11256 - DNA, 17 bp, Homo sapiens
gatcaagacaaaaaata

SEQ ID NO: 11257 - DNA, 17 bp, Homo sapiens
gatcatggagagtcaca

SEQ ID NO: 11258 - DNA, 17 bp, Homo sapiens
gatcaccagtcatccag

SEQ ID NO: 11259 - DNA, 17 bp, Homo sapiens
gatctttggaagggcac

SEQ ID NO: 11260 - DNA, 17 bp, Homo sapiens
gatcagccctctccgcg

SEQ ID NO: 11261 - DNA, 17 bp, Homo sapiens
gatccaaaaaggcgagt

SEQ ID NO: 11262 - DNA, 17 bp, Homo sapiens
gatctgaaagttcttga

SEQ ID NO: 11263 - DNA, 17 bp, Homo sapiens
gatccagattcacatgg

SEQ ID NO: 11264 - DNA, 17 bp, Homo sapiens
gatctgactcaagttca

SEQ ID NO: 11265 - DNA, 17 bp, Homo sapiens
gatcattattccctaaa

SEQ ID NO: 11266 - DNA, 17 bp, Homo sapiens
gatcatttcagtttctt

SEQ ID NO: 11267 - DNA, 17 bp, Homo sapiens
gatcctaattatccttc

SEQ ID NO: 11268 - DNA, 17 bp, Homo sapiens
gatccagaagaaatgag

SEQ ID NO: 11269 - DNA, 17 bp, Homo sapiens
gatcaaagattactatg

SEQ ID NO: 11270 - DNA, 17 bp, Homo sapiens
gatcagattggtgctac

SEQ ID NO: 11271 - DNA, 17 bp, Homo sapiens
gatcgccttcccgtggc

SEQ ID NO: 11272 - DNA, 17 bp, Homo sapiens
gatctggcctcggcttg

SEQ ID NO: 11273 - DNA, 17 bp, Homo sapiens
gatccctggccgggcct

SEQ ID NO: 11274 - DNA, 17 bp, Homo sapiens
gatcaaaatacacaccc

SEQ ID NO: 11275 - DNA, 17 bp, Homo sapiens
gatccaacattcctgcc

SEQ ID NO: 11276 - DNA, 17 bp, Homo sapiens
gatccccaccctgaagg

SEQ ID NO: 11277 - DNA, 17 bp, Homo sapiens
gatcacatttttttttt

SEQ ID NO: 11278 - DNA, 17 bp, Homo sapiens
gatccaattacaaaaca

SEQ ID NO: 11279 - DNA, 17 bp, Homo sapiens
gatccttgggccagccc

SEQ ID NO: 11280 - DNA, 17 bp, Homo sapiens
gatcacatctttttcag

SEQ ID NO: 11281 - DNA, 17 bp, Homo sapiens
gatcggttctttcaaga

SEQ ID NO: 11282 - DNA, 17 bp, Homo sapiens
gatccagtttaccctaa

SEQ ID NO: 11283 - DNA, 17 bp, Homo sapiens
gatcaaaaatagcaaag

SEQ ID NO: 11284 - DNA, 17 bp, Homo sapiens
gatcctttagagttatt

SEQ ID NO: 11285 - DNA, 17 bp, Homo sapiens
gatcatggggtccccat

SEQ ID NO: 11286 - DNA, 17 bp, Homo sapiens
gatctgattattataaa

SEQ ID NO: 11287 - DNA, 17 bp, Homo sapiens
gatcttagagttttgtt

SEQ ID NO: 11288 - DNA, 17 bp, Homo sapiens
gatcaatttggaaaaac

SEQ ID NO: 11289 - DNA, 17 bp, Homo sapiens
gatcctttgctttttaa

SEQ ID NO: 11290 - DNA, 17 bp, Homo sapiens
gatcataaagctgccaa

SEQ ID NO: 11291 - DNA, 17 bp, Homo sapiens
gatcctgaaaattttaa

SEQ ID NO: 11292 - DNA, 17 bp, Homo sapiens
gatctggctcaggttga

SEQ ID NO: 11293 - DNA, 17 bp, Homo sapiens
gatcctacagtttggac

SEQ ID NO: 11294 - DNA, 17 bp, Homo sapiens
gatcttggaaatccaag

SEQ ID NO: 11295 - DNA, 17 bp, Homo sapiens
gatcctgattcacacat

SEQ ID NO: 11296 - DNA, 17 bp, Homo sapiens
gatctcagaagatagaa

SEQ ID NO: 11297 - DNA, 17 bp, Homo sapiens
gatcaggtttcttccat

SEQ ID NO: 11298 - DNA, 17 bp, Homo sapiens
gatccaggagggtcacc

SEQ ID NO: 11299 - DNA, 17 bp, Homo sapiens
gatccagtaagttcagg

SEQ ID NO: 11300 - DNA, 17 bp, Homo sapiens
gatcagggacctttgcc

SEQ ID NO: 11301 - DNA, 17 bp, Homo sapiens
gatcgttttcttcttcc

SEQ ID NO: 11302 - DNA, 17 bp, Homo sapiens
gatcttaaaggggaaaa

SEQ ID NO: 11303 - DNA, 17 bp, Homo sapiens
gatccatttggaatttt

SEQ ID NO: 11304 - DNA, 17 bp, Homo sapiens
gatcctgggcaagccac

SEQ ID NO: 11305 - DNA, 17 bp, Homo sapiens
gatcacataacttagta

SEQ ID NO: 11306 - DNA, 17 bp, Homo sapiens
gatcttccaggttgccc

SEQ ID NO: 11307 - DNA, 17 bp, Homo sapiens
gatctattcaaagacac

SEQ ID NO: 11308 - DNA, 17 bp, Homo sapiens
gatcggtgtgtgagacc

SEQ ID NO: 11309 - DNA, 17 bp, Homo sapiens
gatctgaaaggaataaa

SEQ ID NO: 11310 - DNA, 17 bp, Homo sapiens
gatcaaatttactggtt

SEQ ID NO: 11311 - DNA, 17 bp, Homo sapiens
gatcagataattgtaga

SEQ ID NO: 11312 - DNA, 17 bp, Homo sapiens
gatctgggttggtctgt

SEQ ID NO: 11313 - DNA, 17 bp, Homo sapiens
gatcttctccacatagc

SEQ ID NO: 11314 - DNA, 17 bp, Homo sapiens
gatcagaaaatgtggag

SEQ ID NO: 11315 - DNA, 17 bp, Homo sapiens
gatcagagaagacccct

SEQ ID NO: 11316 - DNA, 17 bp, Homo sapiens
gatcatgagtgctgggg

SEQ ID NO: 11317 - DNA, 17 bp, Homo sapiens
gatctgagctgcttctt

SEQ ID NO: 11318 - DNA, 17 bp, Homo sapiens
gatccttagtgaacatt

SEQ ID NO: 11319 - DNA, 17 bp, Homo sapiens
gatcttctttttctgag

SEQ ID NO: 11320 - DNA, 17 bp, Homo sapiens
gatcctgaacagaagct

SEQ ID NO: 11321 - DNA, 17 bp, Homo sapiens
gatctgtttctatgtcc

SEQ ID NO: 11322 - DNA, 17 bp, Homo sapiens
gatccgaatgtggggtg

SEQ ID NO: 11323 - DNA, 17 bp, Homo sapiens
gatctgaaccagtgttc

SEQ ID NO: 11324 - DNA, 17 bp, Homo sapiens
gatccccacagatggta

SEQ ID NO: 11325 - DNA, 17 bp, Homo sapiens
gatccttattgtctagc

SEQ ID NO: 11326 - DNA, 17 bp, Homo sapiens
gatcctgtctaaaacaa

SEQ ID NO: 11327 - DNA, 17 bp, Homo sapiens
gatccagcattggggcc

SEQ ID NO: 11328 - DNA, 17 bp, Homo sapiens
gatcagagaataagctt

SEQ ID NO: 11329 - DNA, 17 bp, Homo sapiens
gatctttattttacgtt

SEQ ID NO: 11330 - DNA, 17 bp, Homo sapiens
gatctgcaaacttgtta

SEQ ID NO: 11331 - DNA, 17 bp, Homo sapiens
gatcgccctggagggag

SEQ ID NO: 11332 - DNA, 17 bp, Homo sapiens
gatctgcctgcctctgg

SEQ ID NO: 11333 - DNA, 17 bp, Homo sapiens
gatcatctttctgcaga

SEQ ID NO: 11334 - DNA, 17 bp, Homo sapiens
gatccaatttggtatgt

SEQ ID NO: 11335 - DNA, 17 bp, Homo sapiens
gatccagtcacttctct

SEQ ID NO: 11336 - DNA, 17 bp, Homo sapiens
gatcctgaaagcgatga

SEQ ID NO: 11337 - DNA, 17 bp, Homo sapiens
gatcccgccactacact

SEQ ID NO: 11338 - DNA, 17 bp, Homo sapiens
gatccgaaatattcagc

SEQ ID NO: 11339 - DNA, 17 bp, Homo sapiens
gatcccgagagctgact

SEQ ID NO: 11340 - DNA, 17 bp, Homo sapiens
gatctttccaggaaaat

SEQ ID NO: 11341 - DNA, 17 bp, Homo sapiens
gatctgctcaccttgac

SEQ ID NO: 11342 - DNA, 17 bp, Homo sapiens
gatcctccagcccagcc

SEQ ID NO: 11343 - DNA, 17 bp, Homo sapiens
gatccttccaagtttgg

SEQ ID NO: 11344 - DNA, 17 bp, Homo sapiens
gatcttgacaagggcag

SEQ ID NO: 11345 - DNA, 17 bp, Homo sapiens
gatccattggccaggaa

SEQ ID NO: 11346 - DNA, 17 bp, Homo sapiens
gatcattgctcaaatgg

SEQ ID NO: 11347 - DNA, 17 bp, Homo sapiens
gatcctgccggccatcc

SEQ ID NO: 11348 - DNA, 17 bp, Homo sapiens
gatcaattttctaagaa

SEQ ID NO: 11349 - DNA, 17 bp, Homo sapiens
gatctatgtccggtgtg

SEQ ID NO: 11350 - DNA, 17 bp, Homo sapiens
gatccttttttttttcc

SEQ ID NO: 11351 - DNA, 17 bp, Homo sapiens
gatcacggaaaaccttc

SEQ ID NO: 11352 - DNA, 17 bp, Homo sapiens
gatccatctgcctttct

SEQ ID NO: 11353 - DNA, 17 bp, Homo sapiens
gatcatcagctttttaa

SEQ ID NO: 11354 - DNA, 17 bp, Homo sapiens
gatcaaccttcaactat

SEQ ID NO: 11355 - DNA, 17 bp, Homo sapiens
gatcatcgctgtatcta

SEQ ID NO: 11356 - DNA, 17 bp, Homo sapiens
gatcctcttaccttgcc

SEQ ID NO: 11357 - DNA, 17 bp, Homo sapiens
gatccacaaagctgcct

SEQ ID NO: 11358 - DNA, 17 bp, Homo sapiens
gatccctgtggttacga

SEQ ID NO: 11359 - DNA, 17 bp, Homo sapiens
gatctgagatatactgg

SEQ ID NO: 11360 - DNA, 17 bp, Homo sapiens
gatcatgcccctgctag

SEQ ID NO: 11361 - DNA, 17 bp, Homo sapiens
gatcacactgcacagag

SEQ ID NO: 11362 - DNA, 17 bp, Homo sapiens
gatccatgttgttcaag

SEQ ID NO: 11363 - DNA, 17 bp, Homo sapiens
gatctggacctattttt

SEQ ID NO: 11364 - DNA, 17 bp, Homo sapiens
gatctatttttcaactg

SEQ ID NO: 11365 - DNA, 17 bp, Homo sapiens
gatcatttctcaaacca

SEQ ID NO: 11366 - DNA, 17 bp, Homo sapiens
gatctgcatccactcat

SEQ ID NO: 11367 - DNA, 17 bp, Homo sapiens
gatcccagacggttagc

SEQ ID NO: 11368 - DNA, 17 bp, Homo sapiens
gatctgaaagaagccag

SEQ ID NO: 11369 - DNA, 17 bp, Homo sapiens
gatccttcagccccagt

SEQ ID NO: 11370 - DNA, 17 bp, Homo sapiens
gatcaaaagatgtttaa

SEQ ID NO: 11371 - DNA, 17 bp, Homo sapiens
gatcctcaattgccacc

SEQ ID NO: 11372 - DNA, 17 bp, Homo sapiens
gatcattgttcttcaag

SEQ ID NO: 11373 - DNA, 17 bp, Homo sapiens
gatcagccaaataaacc

SEQ ID NO: 11374 - DNA, 17 bp, Homo sapiens
gatccagcactgagcca

SEQ ID NO: 11375 - DNA, 17 bp, Homo sapiens
gatccactgtcttttaa

SEQ ID NO: 11376 - DNA, 17 bp, Homo sapiens
gatccgagggcgagcac

SEQ ID NO: 11377 - DNA, 17 bp, Homo sapiens
gatccacccacttcgac

SEQ ID NO: 11378 - DNA, 17 bp, Homo sapiens
gatcgttaactattttt

SEQ ID NO: 11379 - DNA, 17 bp, Homo sapiens
gatccactctggctaac

SEQ ID NO: 11380 - DNA, 17 bp, Homo sapiens
gatcagttcatgatacc

SEQ ID NO: 11381 - DNA, 17 bp, Homo sapiens
gatcttcactctgaata

SEQ ID NO: 11382 - DNA, 17 bp, Homo sapiens
gatctaacaatcctcac

SEQ ID NO: 11383 - DNA, 17 bp, Homo sapiens
gatctaataaatgaaag

SEQ ID NO: 11384 - DNA, 17 bp, Homo sapiens
gatcttattagacggaa

SEQ ID NO: 11385 - DNA, 17 bp, Homo sapiens
gatcctctaatacccgg

SEQ ID NO: 11386 - DNA, 17 bp, Homo sapiens
gatccttcaggcaaatg

SEQ ID NO: 11387 - DNA, 17 bp, Homo sapiens
gatcttcataagtactc

SEQ ID NO: 11388 - DNA, 17 bp, Homo sapiens
gatcttacaggtgtttt

SEQ ID NO: 11389 - DNA, 17 bp, Homo sapiens
gatcgcctcctctgagg

SEQ ID NO: 11390 - DNA, 17 bp, Homo sapiens
gatctaaaatgctggtt

SEQ ID NO: 11391 - DNA, 17 bp, Homo sapiens
gatcacaacagtatgag

SEQ ID NO: 11392 - DNA, 17 bp, Homo sapiens
gatcacatagccagtca

SEQ ID NO: 11393 - DNA, 17 bp, Homo sapiens
gatcatttttcactaaa

SEQ ID NO: 11394 - DNA, 17 bp, Homo sapiens
gatctttttgagtgctg

SEQ ID NO: 11395 - DNA, 17 bp, Homo sapiens
gatctcaaagacggatt

SEQ ID NO: 11396 - DNA, 17 bp, Homo sapiens
gatctccacatccggga

SEQ ID NO: 11397 - DNA, 17 bp, Homo sapiens
gatctgtgcaacgaaag

SEQ ID NO: 11398 - DNA, 17 bp, Homo sapiens
gatcaatcattcccagc

SEQ ID NO: 11399 - DNA, 17 bp, Homo sapiens
gatccaagacccacttg

SEQ ID NO: 11400 - DNA, 17 bp, Homo sapiens
gatcccgacactttggg

SEQ ID NO: 11401 - DNA, 17 bp, Homo sapiens
gatccccagagaaggca

SEQ ID NO: 11402 - DNA, 17 bp, Homo sapiens
gatctccctttgttgcc

SEQ ID NO: 11403 - DNA, 17 bp, Homo sapiens
gatctgatttcaaattg

SEQ ID NO: 11404 - DNA, 17 bp, Homo sapiens
gatcatagtcttctggt

SEQ ID NO: 11405 - DNA, 17 bp, Homo sapiens
gatctgctacggcatgt

SEQ ID NO: 11406 - DNA, 17 bp, Homo sapiens
gatcaaaaagcagcagc

SEQ ID NO: 11407 - DNA, 17 bp, Homo sapiens
gatcagaaaatgaaacc

SEQ ID NO: 11408 - DNA, 17 bp, Homo sapiens
gatcttctttttttgag

SEQ ID NO: 11409 - DNA, 17 bp, Homo sapiens
gatctttgaatactcca

SEQ ID NO: 11410 - DNA, 17 bp, Homo sapiens
gatcccagcactttggt

SEQ ID NO: 11411 - DNA, 17 bp, Homo sapiens
gatctgcgacacccagt

SEQ ID NO: 11412 - DNA, 17 bp, Homo sapiens
gatcgtcgaatcccgac

SEQ ID NO: 11413 - DNA, 17 bp, Homo sapiens
gatcctcctccagtgct

SEQ ID NO: 11414 - DNA, 17 bp, Homo sapiens
gatcaggcacatgagtg

SEQ ID NO: 11415 - DNA, 17 bp, Homo sapiens
gatccttaggttgatgc

SEQ ID NO: 11416 - DNA, 17 bp, Homo sapiens
gatccaagtcattacca

SEQ ID NO: 11417 - DNA, 17 bp, Homo sapiens
gatcgggtcttccttca

SEQ ID NO: 11418 - DNA, 17 bp, Homo sapiens
gatctaaaatgctaagt

SEQ ID NO: 11419 - DNA, 17 bp, Homo sapiens
gatcttcacattccaag

SEQ ID NO: 11420 - DNA, 17 bp, Homo sapiens
gatctttgataacctgt

SEQ ID NO: 11421 - DNA, 17 bp, Homo sapiens
gatctatgaaataggta

SEQ ID NO: 11422 - DNA, 17 bp, Homo sapiens
gatccacaagctatggc

SEQ ID NO: 11423 - DNA, 17 bp, Homo sapiens
gatcctctccactcagt

SEQ ID NO: 11424 - DNA, 17 bp, Homo sapiens
gatctctctcacacatc

SEQ ID NO: 11425 - DNA, 17 bp, Homo sapiens
gatccaatccaaagttg

SEQ ID NO: 11426 - DNA, 17 bp, Homo sapiens
gatcacatttttctgag

SEQ ID NO: 11427 - DNA, 17 bp, Homo sapiens
gatcttcattttattga

SEQ ID NO: 11428 - DNA, 17 bp, Homo sapiens
gatctattttttgtttt

SEQ ID NO: 11429 - DNA, 17 bp, Homo sapiens
gatcacccaagcctggg

SEQ ID NO: 11430 - DNA, 17 bp, Homo sapiens
gatctggcctgaaggcc

SEQ ID NO: 11431 - DNA, 17 bp, Homo sapiens
gatctctgtttgcttcc

SEQ ID NO: 11432 - DNA, 17 bp, Homo sapiens
gatctgtttatcttatg

SEQ ID NO: 11433 - DNA, 17 bp, Homo sapiens
gatcagcttttccttca

SEQ ID NO: 11434 - DNA, 17 bp, Homo sapiens
gatctcaaccggaacct

SEQ ID NO: 11435 - DNA, 17 bp, Homo sapiens
gatctccccggctcaag

SEQ ID NO: 11436 - DNA, 17 bp, Homo sapiens
gatcaacattatgagat

SEQ ID NO: 11437 - DNA, 17 bp, Homo sapiens
gatcctgggaggtccag

SEQ ID NO: 11438 - DNA, 17 bp, Homo sapiens
gatctatacctctgttt

SEQ ID NO: 11439 - DNA, 17 bp, Homo sapiens
gatcatcatcattgcat

SEQ ID NO: 11440 - DNA, 17 bp, Homo sapiens
gatccagttctgggatg

SEQ ID NO: 11441 - DNA, 17 bp, Homo sapiens
gatcacctgtgtgtttt

SEQ ID NO: 11442 - DNA, 17 bp, Homo sapiens
gatcagccttaagaaag

SEQ ID NO: 11443 - DNA, 17 bp, Homo sapiens
gatctgcagatggacac

SEQ ID NO: 11444 - DNA, 17 bp, Homo sapiens
gatcttccatgtcatat

SEQ ID NO: 11445 - DNA, 17 bp, Homo sapiens
gatcctccttcaccagc

SEQ ID NO: 11446 - DNA, 17 bp, Homo sapiens
gatctgaagagacagta

SEQ ID NO: 11447 - DNA, 17 bp, Homo sapiens
gatctgacccttgttct

SEQ ID NO: 11448 - DNA, 17 bp, Homo sapiens
gatctgacctgtcacct

SEQ ID NO: 11449 - DNA, 17 bp, Homo sapiens
gatctttctgccttttt

SEQ ID NO: 11450 - DNA, 17 bp, Homo sapiens
gatcatgctttgccctt

SEQ ID NO: 11451 - DNA, 17 bp, Homo sapiens
gatcaccagaatcccaa

SEQ ID NO: 11452 - DNA, 17 bp, Homo sapiens
gatctatagtctgtttc

SEQ ID NO: 11453 - DNA, 17 bp, Homo sapiens
gatcagaatgtgttata

SEQ ID NO: 11454 - DNA, 17 bp, Homo sapiens
gatctcccagggtgatt

SEQ ID NO: 11455 - DNA, 17 bp, Homo sapiens
gatcagttggactagtg

SEQ ID NO: 11456 - DNA, 17 bp, Homo sapiens
gatctgaggctcgccgg

SEQ ID NO: 11457 - DNA, 17 bp, Homo sapiens
gatcactccatagcatc

SEQ ID NO: 11458 - DNA, 17 bp, Homo sapiens
gatcctcctgcgtttac

SEQ ID NO: 11459 - DNA, 17 bp, Homo sapiens
gatctagtttaaagcaa

SEQ ID NO: 11460 - DNA, 17 bp, Homo sapiens
gatccagcagctccaag

SEQ ID NO: 11461 - DNA, 17 bp, Homo sapiens
gatctggttttgccttt

SEQ ID NO: 11462 - DNA, 17 bp, Homo sapiens
gatctcaaatcccagac

SEQ ID NO: 11463 - DNA, 17 bp, Homo sapiens
gatccttggtttcttta

SEQ ID NO: 11464 - DNA, 17 bp, Homo sapiens
gatctggaaggacagaa

SEQ ID NO: 11465 - DNA, 17 bp, Homo sapiens
gatcgttgttgtgggag

SEQ ID NO: 11466 - DNA, 17 bp, Homo sapiens
gatccaagaggacccgg

SEQ ID NO: 11467 - DNA, 17 bp, Homo sapiens
gatcctaaattacattc

SEQ ID NO: 11468 - DNA, 17 bp, Homo sapiens
gatccacaaccttggtg

SEQ ID NO: 11469 - DNA, 17 bp, Homo sapiens
gatccctagcaagtaat

SEQ ID NO: 11470 - DNA, 17 bp, Homo sapiens
gatccagggactcagat

SEQ ID NO: 11471 - DNA, 17 bp, Homo sapiens
gatcaatcagtgttaaa

SEQ ID NO: 11472 - DNA, 17 bp, Homo sapiens
gatccttctccctcttc

SEQ ID NO: 11473 - DNA, 17 bp, Homo sapiens
gatccaggtcccactaa

SEQ ID NO: 11474 - DNA, 17 bp, Homo sapiens
gatcagtctcttcatac

SEQ ID NO: 11475 - DNA, 17 bp, Homo sapiens
gatccactttacatcat

SEQ ID NO: 11476 - DNA, 17 bp, Homo sapiens
gatctcagcactagaaa

SEQ ID NO: 11477 - DNA, 17 bp, Homo sapiens
gatctaaagtgcaagcc

SEQ ID NO: 11478 - DNA, 17 bp, Homo sapiens
gatctcacaggcagggc

SEQ ID NO: 11479 - DNA, 17 bp, Homo sapiens
gatccgcctgcccagcc

SEQ ID NO: 11480 - DNA, 17 bp, Homo sapiens
gatcctcctgcctcaca

SEQ ID NO: 11481 - DNA, 17 bp, Homo sapiens
gatcacagtaatgaatt

SEQ ID NO: 11482 - DNA, 17 bp, Homo sapiens
gatcattttgttttaag

SEQ ID NO: 11483 - DNA, 17 bp, Homo sapiens
gatcactgtgcacccag

SEQ ID NO: 11484 - DNA, 17 bp, Homo sapiens
gatcatttctgctaaat

SEQ ID NO: 11485 - DNA, 17 bp, Homo sapiens
gatcccaaggagagagg

SEQ ID NO: 11486 - DNA, 17 bp, Homo sapiens
gatccaactgcttctgc

SEQ ID NO: 11487 - DNA, 17 bp, Homo sapiens
gatctgatttggcagta

SEQ ID NO: 11488 - DNA, 17 bp, Homo sapiens
gatcttaaattagtata

SEQ ID NO: 11489 - DNA, 17 bp, Homo sapiens
gatctttttgtgtgcgt

SEQ ID NO: 11490 - DNA, 17 bp, Homo sapiens
gatccagcccctgcgtc

SEQ ID NO: 11491 - DNA, 17 bp, Homo sapiens
gatcgtggcaaaagtaa

SEQ ID NO: 11492 - DNA, 17 bp, Homo sapiens
gatccttcccaacgtac

SEQ ID NO: 11493 - DNA, 17 bp, Homo sapiens
gatccactgagggagga

SEQ ID NO: 11494 - DNA, 17 bp, Homo sapiens
gatccaggagagaagat

SEQ ID NO: 11495 - DNA, 17 bp, Homo sapiens
gatctgagaaaggagta

SEQ ID NO: 11496 - DNA, 17 bp, Homo sapiens
gatccacccgcctggct

SEQ ID NO: 11497 - DNA, 17 bp, Homo sapiens
gatccaaaagaaggcaa

SEQ ID NO: 11498 - DNA, 17 bp, Homo sapiens
gatcccaattcctatct

SEQ ID NO: 11499 - DNA, 17 bp, Homo sapiens
gatctcagacagagcta

SEQ ID NO: 11500 - DNA, 17 bp, Homo sapiens
gatctgcttcttagacc

SEQ ID NO: 11501 - DNA, 17 bp, Homo sapiens
gatcacaagtgtgagct

SEQ ID NO: 11502 - DNA, 17 bp, Homo sapiens
gatcttagtaggaagga

SEQ ID NO: 11503 - DNA, 17 bp, Homo sapiens
gatcacatgtacatgca

SEQ ID NO: 11504 - DNA, 17 bp, Homo sapiens
gatctgatttagagtcc

SEQ ID NO: 11505 - DNA, 17 bp, Homo sapiens
gatcattttctagctgt

SEQ ID NO: 11506 - DNA, 17 bp, Homo sapiens
gatcaatttacttctcc

SEQ ID NO: 11507 - DNA, 17 bp, Homo sapiens
gatccacccaaagtgct

SEQ ID NO: 11508 - DNA, 17 bp, Homo sapiens
gatcatgtttttctcca

SEQ ID NO: 11509 - DNA, 17 bp, Homo sapiens
gatctaagaagaaactt

SEQ ID NO: 11510 - DNA, 17 bp, Homo sapiens
gatcaatttttatttca

SEQ ID NO: 11511 - DNA, 17 bp, Homo sapiens
gatccggtcgcggggca

SEQ ID NO: 11512 - DNA, 17 bp, Homo sapiens
gatcatcttgagaagta

SEQ ID NO: 11513 - DNA, 17 bp, Homo sapiens
gatcctcgaggtcaatg

SEQ ID NO: 11514 - DNA, 17 bp, Homo sapiens
gatccagtctcaccagg

SEQ ID NO: 11515 - DNA, 17 bp, Homo sapiens
gatcctgggataatgaa

SEQ ID NO: 11516 - DNA, 17 bp, Homo sapiens
gatccttttccaatact

SEQ ID NO: 11517 - DNA, 17 bp, Homo sapiens
gatccaccccactcagc

SEQ ID NO: 11518 - DNA, 17 bp, Homo sapiens
gatctattcttctcata

SEQ ID NO: 11519 - DNA, 17 bp, Homo sapiens
gatcagaacccaagctt

SEQ ID NO: 11520 - DNA, 17 bp, Homo sapiens
gatcctcagggctgtcc

SEQ ID NO: 11521 - DNA, 17 bp, Homo sapiens
gatcattatgcactgct

SEQ ID NO: 11522 - DNA, 17 bp, Homo sapiens
gatcacccatgtgcaac

SEQ ID NO: 11523 - DNA, 17 bp, Homo sapiens
gatcccataaaaaaaaa

SEQ ID NO: 11524 - DNA, 17 bp, Homo sapiens
gatctgctttagtcact

SEQ ID NO: 11525 - DNA, 17 bp, Homo sapiens
gatcttcccagaggaat

SEQ ID NO: 11526 - DNA, 17 bp, Homo sapiens
gatcatgttctgtgcat

SEQ ID NO: 11527 - DNA, 17 bp, Homo sapiens
gatctatcgtctttgat

SEQ ID NO: 11528 - DNA, 17 bp, Homo sapiens
gatctctggaagtaata

SEQ ID NO: 11529 - DNA, 17 bp, Homo sapiens
gatcacatgagccaaag

SEQ ID NO: 11530 - DNA, 17 bp, Homo sapiens
gatcacattgacaaagt

SEQ ID NO: 11531 - DNA, 17 bp, Homo sapiens
gatctgagaggaagagg

SEQ ID NO: 11532 - DNA, 17 bp, Homo sapiens
gatcaggttttgcctag

SEQ ID NO: 11533 - DNA, 17 bp, Homo sapiens
gatcctctgtacatatt

SEQ ID NO: 11534 - DNA, 17 bp, Homo sapiens
gatcgagatgaagcttt

SEQ ID NO: 11535 - DNA, 17 bp, Homo sapiens
gatccaaacagccaaaa

SEQ ID NO: 11536 - DNA, 17 bp, Homo sapiens
gatctgcatctcagaaa

SEQ ID NO: 11537 - DNA, 17 bp, Homo sapiens
gatcatggcaacactgt

SEQ ID NO: 11538 - DNA, 17 bp, Homo sapiens
gatcttgaggactcagg

SEQ ID NO: 11539 - DNA, 17 bp, Homo sapiens
gatcagaaaaatcttta

SEQ ID NO: 11540 - DNA, 17 bp, Homo sapiens
gatccacagggtcagtg

SEQ ID NO: 11541 - DNA, 17 bp, Homo sapiens
gatcaggtctccaggag

SEQ ID NO: 11542 - DNA, 17 bp, Homo sapiens
gatccagcaggtggcac

SEQ ID NO: 11543 - DNA, 17 bp, Homo sapiens
gatccgtgcttgccgtc

SEQ ID NO: 11544 - DNA, 17 bp, Homo sapiens
gatctgagaaatggggg

SEQ ID NO: 11545 - DNA, 17 bp, Homo sapiens
gatcttctcacaattca

SEQ ID NO: 11546 - DNA, 17 bp, Homo sapiens
gatcaagccgccggtca

SEQ ID NO: 11547 - DNA, 17 bp, Homo sapiens
gatcaaatctgaaagta

SEQ ID NO: 11548 - DNA, 17 bp, Homo sapiens
gatctccttatggtctt

SEQ ID NO: 11549 - DNA, 17 bp, Homo sapiens
gatctttcttctctgct

SEQ ID NO: 11550 - DNA, 17 bp, Homo sapiens
gatctgaacccccccgc

SEQ ID NO: 11551 - DNA, 17 bp, Homo sapiens
gatcccacctgctccac

SEQ ID NO: 11552 - DNA, 17 bp, Homo sapiens
gatcattcttcacccaa

SEQ ID NO: 11553 - DNA, 17 bp, Homo sapiens
gatctttgcccactggg

SEQ ID NO: 11554 - DNA, 17 bp, Homo sapiens
gatccctgagctgcttc

SEQ ID NO: 11555 - DNA, 17 bp, Homo sapiens
gatctgagtaatccctg

SEQ ID NO: 11556 - DNA, 17 bp, Homo sapiens
gatctggctgctcttgg

SEQ ID NO: 11557 - DNA, 17 bp, Homo sapiens
gatctgtcagaaaagca

SEQ ID NO: 11558 - DNA, 17 bp, Homo sapiens
gatcttcccaaactatc

SEQ ID NO: 11559 - DNA, 17 bp, Homo sapiens
gatctggggcaagtcat

SEQ ID NO: 11560 - DNA, 17 bp, Homo sapiens
gatccaagatagcacca

SEQ ID NO: 11561 - DNA, 17 bp, Homo sapiens
gatccccaggccgcgga

SEQ ID NO: 11562 - DNA, 17 bp, Homo sapiens
gatctccttcccccttc

SEQ ID NO: 11563 - DNA, 17 bp, Homo sapiens
gatcctactagttactt

SEQ ID NO: 11564 - DNA, 17 bp, Homo sapiens
gatcttcgctcctctct

SEQ ID NO: 11565 - DNA, 17 bp, Homo sapiens
gatccagagagaaattg

SEQ ID NO: 11566 - DNA, 17 bp, Homo sapiens
gatctccgtgtccattt

SEQ ID NO: 11567 - DNA, 17 bp, Homo sapiens
gatctgcctctctcaga

SEQ ID NO: 11568 - DNA, 17 bp, Homo sapiens
gatccatgtactctctc

SEQ ID NO: 11569 - DNA, 17 bp, Homo sapiens
gatctttttactgtgtc

SEQ ID NO: 11570 - DNA, 17 bp, Homo sapiens
gatcaaaacaataggtt

SEQ ID NO: 11571 - DNA, 17 bp, Homo sapiens
gatcagtgaactggaag

SEQ ID NO: 11572 - DNA, 17 bp, Homo sapiens
gatcaaagccaagtgca

SEQ ID NO: 11573 - DNA, 17 bp, Homo sapiens
gatctgcccctcctctg

SEQ ID NO: 11574 - DNA, 17 bp, Homo sapiens
gatcaaaaatctacaat

SEQ ID NO: 11575 - DNA, 17 bp, Homo sapiens
gatctgttttcaaatgt

SEQ ID NO: 11576 - DNA, 17 bp, Homo sapiens
gatccctcttgcttctt

SEQ ID NO: 11577 - DNA, 17 bp, Homo sapiens
gatctcttcagacatct

SEQ ID NO: 11578 - DNA, 17 bp, Homo sapiens
gatccccccattgcact

SEQ ID NO: 11579 - DNA, 17 bp, Homo sapiens
gatctacagtccatttg

SEQ ID NO: 11580 - DNA, 17 bp, Homo sapiens
gatctggtttggtaaaa

SEQ ID NO: 11581 - DNA, 17 bp, Homo sapiens
gatctggtttggtacaa

SEQ ID NO: 11582 - DNA, 17 bp, Homo sapiens
gatcaacatcagggctg

SEQ ID NO: 11583 - DNA, 17 bp, Homo sapiens
gatcacaataaagtcaa

SEQ ID NO: 11584 - DNA, 17 bp, Homo sapiens
gatccacctatgtactg

SEQ ID NO: 11585 - DNA, 17 bp, Homo sapiens
gatcagcaagagttaga

SEQ ID NO: 11586 - DNA, 17 bp, Homo sapiens
gatcagtgggggaacag

SEQ ID NO: 11587 - DNA, 17 bp, Homo sapiens
gatctcaggcttccagc

SEQ ID NO: 11588 - DNA, 17 bp, Homo sapiens
gatctgttggtctggaa

SEQ ID NO: 11589 - DNA, 17 bp, Homo sapiens
gatcctactaggacctt

SEQ ID NO: 11590 - DNA, 17 bp, Homo sapiens
gatcatatcattcggat

SEQ ID NO: 11591 - DNA, 17 bp, Homo sapiens
gatctgaagtaagagat

SEQ ID NO: 11592 - DNA, 17 bp, Homo sapiens
gatcatcataaagtctt

SEQ ID NO: 11593 - DNA, 17 bp, Homo sapiens
gatcctctttccatcac

SEQ ID NO: 11594 - DNA, 17 bp, Homo sapiens
gatcattgtacttattt

SEQ ID NO: 11595 - DNA, 17 bp, Homo sapiens
gatctgcctagcagaaa

SEQ ID NO: 11596 - DNA, 17 bp, Homo sapiens
gatcaataatttcaaaa

SEQ ID NO: 11597 - DNA, 17 bp, Homo sapiens
gatcccaagtgcctgga

SEQ ID NO: 11598 - DNA, 17 bp, Homo sapiens
gatccgctgcaaacaat

SEQ ID NO: 11599 - DNA, 17 bp, Homo sapiens
gatccttttttgattga

SEQ ID NO: 11600 - DNA, 17 bp, Homo sapiens
gatctgggaggcagagg

SEQ ID NO: 11601 - DNA, 17 bp, Homo sapiens
gatccaagtgctgttgt

SEQ ID NO: 11602 - DNA, 17 bp, Homo sapiens
gatccgcctgccactgc

SEQ ID NO: 11603 - DNA, 17 bp, Homo sapiens
gatccaggcatggtggt

SEQ ID NO: 11604 - DNA, 17 bp, Homo sapiens
gatctaatacaaaccaa

SEQ ID NO: 11605 - DNA, 17 bp, Homo sapiens
gatccacctggctgctg

SEQ ID NO: 11606 - DNA, 17 bp, Homo sapiens
gatcctatagcttacat

SEQ ID NO: 11607 - DNA, 17 bp, Homo sapiens
gatcttacagcgcagca

SEQ ID NO: 11608 - DNA, 17 bp, Homo sapiens
gatccttagcttaatca

SEQ ID NO: 11609 - DNA, 17 bp, Homo sapiens
gatctctggggtatata

SEQ ID NO: 11610 - DNA, 17 bp, Homo sapiens
gatcgtcaacaggtggg

SEQ ID NO: 11611 - DNA, 17 bp, Homo sapiens
gatctctttccctggct

SEQ ID NO: 11612 - DNA, 17 bp, Homo sapiens
gatcaaaagttcttggg

SEQ ID NO: 11613 - DNA, 17 bp, Homo sapiens
gatccaatccattagcc

SEQ ID NO: 11614 - DNA, 17 bp, Homo sapiens
gatcaatgaccactttc

SEQ ID NO: 11615 - DNA, 17 bp, Homo sapiens
gatccctggcctccagc

SEQ ID NO: 11616 - DNA, 17 bp, Homo sapiens
gatccaattagcttatt

SEQ ID NO: 11617 - DNA, 17 bp, Homo sapiens
gatctgacaccctcttg

SEQ ID NO: 11618 - DNA, 17 bp, Homo sapiens
gatcagttggtccttct

SEQ ID NO: 11619 - DNA, 17 bp, Homo sapiens
gatcatgttgccattac

SEQ ID NO: 11620 - DNA, 17 bp, Homo sapiens
gatccccaaggttttca

SEQ ID NO: 11621 - DNA, 17 bp, Homo sapiens
gatctgcatctttggtt

SEQ ID NO: 11622 - DNA, 17 bp, Homo sapiens
gatcatcactttgtatt

SEQ ID NO: 11623 - DNA, 17 bp, Homo sapiens
gatctaatctcactctg

SEQ ID NO: 11624 - DNA, 17 bp, Homo sapiens
gatcggagggctttttt

SEQ ID NO: 11625 - DNA, 17 bp, Homo sapiens
gatcttcggagaggtgt

SEQ ID NO: 11626 - DNA, 17 bp, Homo sapiens
gatccccatcatttcct

SEQ ID NO: 11627 - DNA, 17 bp, Homo sapiens
gatcaaactacattact

SEQ ID NO: 11628 - DNA, 17 bp, Homo sapiens
gatcatctaagcgatgg

SEQ ID NO: 11629 - DNA, 17 bp, Homo sapiens
gatcagagatgatactc

SEQ ID NO: 11630 - DNA, 17 bp, Homo sapiens
gatcccagcacttaggg

SEQ ID NO: 11631 - DNA, 17 bp, Homo sapiens
gatcattaagcaataaa

SEQ ID NO: 11632 - DNA, 17 bp, Homo sapiens
gatcacctcaattggac

SEQ ID NO: 11633 - DNA, 17 bp, Homo sapiens
gatctattccacataga

SEQ ID NO: 11634 - DNA, 17 bp, Homo sapiens
gatcatatgatgtgtaa

SEQ ID NO: 11635 - DNA, 17 bp, Homo sapiens
gatccggtggcgctgag

SEQ ID NO: 11636 - DNA, 17 bp, Homo sapiens
gatctccttgaaatgcc

SEQ ID NO: 11637 - DNA, 17 bp, Homo sapiens
gatcatcctcttcaaat

SEQ ID NO: 11638 - DNA, 17 bp, Homo sapiens
gatccagaccatctttt

SEQ ID NO: 11639 - DNA, 17 bp, Homo sapiens
gatcccaacaggttccc

SEQ ID NO: 11640 - DNA, 17 bp, Homo sapiens
gatcttcccttgttttt

SEQ ID NO: 11641 - DNA, 17 bp, Homo sapiens
gatcagtttacaagttt

SEQ ID NO: 11642 - DNA, 17 bp, Homo sapiens
gatcagacataataggc

SEQ ID NO: 11643 - DNA, 17 bp, Homo sapiens
gatcgctttgttctcat

SEQ ID NO: 11644 - DNA, 17 bp, Homo sapiens
gatcagtttcagtggtg

SEQ ID NO: 11645 - DNA, 17 bp, Homo sapiens
gatctttcctgatttct

SEQ ID NO: 11646 - DNA, 17 bp, Homo sapiens
gatcatattcattcaaa

SEQ ID NO: 11647 - DNA, 17 bp, Homo sapiens
gatccaagtccaagctt

SEQ ID NO: 11648 - DNA, 17 bp, Homo sapiens
gatctatgtaatcgcag

SEQ ID NO: 11649 - DNA, 17 bp, Homo sapiens
gatctattttctattaa

SEQ ID NO: 11650 - DNA, 17 bp, Homo sapiens
gatctcagtaacagtac

SEQ ID NO: 11651 - DNA, 17 bp, Homo sapiens
gatcgtgtattctactt

SEQ ID NO: 11652 - DNA, 17 bp, Homo sapiens
gatcttgacagatttgc

SEQ ID NO: 11653 - DNA, 17 bp, Homo sapiens
gatctttatcattctgt

SEQ ID NO: 11654 - DNA, 17 bp, Homo sapiens
gatcatgtcttccctct

SEQ ID NO: 11655 - DNA, 17 bp, Homo sapiens
gatctttgttttttttc

SEQ ID NO: 11656 - DNA, 17 bp, Homo sapiens
gatccggcgtcactggg

SEQ ID NO: 11657 - DNA, 17 bp, Homo sapiens
gatcatttctcatttta

SEQ ID NO: 11658 - DNA, 17 bp, Homo sapiens
gatcagacggaaattgt

SEQ ID NO: 11659 - DNA, 17 bp, Homo sapiens
gatctgaaagttatgtg

SEQ ID NO: 11660 - DNA, 17 bp, Homo sapiens
gatccgaagggatgtgg

SEQ ID NO: 11661 - DNA, 17 bp, Homo sapiens
gatctggttggaaagag

SEQ ID NO: 11662 - DNA, 17 bp, Homo sapiens
gatccaggagcacagga

SEQ ID NO: 11663 - DNA, 17 bp, Homo sapiens
gatcacaggggcatgcc

SEQ ID NO: 11664 - DNA, 17 bp, Homo sapiens
gatcccgtctctattaa

SEQ ID NO: 11665 - DNA, 17 bp, Homo sapiens
gatccaccttttcatgt

SEQ ID NO: 11666 - DNA, 17 bp, Homo sapiens
gatcctattcacagctt

SEQ ID NO: 11667 - DNA, 17 bp, Homo sapiens
gatcatcctagctgctg

SEQ ID NO: 11668 - DNA, 17 bp, Homo sapiens
gatctggggtggggcct

SEQ ID NO: 11669 - DNA, 17 bp, Homo sapiens
gatcaattcctttcact

SEQ ID NO: 11670 - DNA, 17 bp, Homo sapiens
gatctggcaagaccaca

SEQ ID NO: 11671 - DNA, 17 bp, Homo sapiens
gatctttgcgaattaca

SEQ ID NO: 11672 - DNA, 17 bp, Homo sapiens
gatcctgggtaggccta

SEQ ID NO: 11673 - DNA, 17 bp, Homo sapiens
gatcctgttcgggagtt

SEQ ID NO: 11674 - DNA, 17 bp, Homo sapiens
gatcctcttgtttcagc

SEQ ID NO: 11675 - DNA, 17 bp, Homo sapiens
gatccttactattattt

SEQ ID NO: 11676 - DNA, 17 bp, Homo sapiens
gatcttgttttgcgaaa

SEQ ID NO: 11677 - DNA, 17 bp, Homo sapiens
gatccaaattgtcttta

SEQ ID NO: 11678 - DNA, 17 bp, Homo sapiens
gatctaggtttgagtgt

SEQ ID NO: 11679 - DNA, 17 bp, Homo sapiens
gatccaccttccaaagt

SEQ ID NO: 11680 - DNA, 17 bp, Homo sapiens
gatcaatcagcaataaa

SEQ ID NO: 11681 - DNA, 17 bp, Homo sapiens
gatccccactctttcct

SEQ ID NO: 11682 - DNA, 17 bp, Homo sapiens
gatccatctttatttcc

SEQ ID NO: 11683 - DNA, 17 bp, Homo sapiens
gatccaaccccagggag

SEQ ID NO: 11684 - DNA, 17 bp, Homo sapiens
gatctttccatttctcc

SEQ ID NO: 11685 - DNA, 17 bp, Homo sapiens
gatcccacgcaggtctg

SEQ ID NO: 11686 - DNA, 17 bp, Homo sapiens
gatcgtaacatgtgcag

SEQ ID NO: 11687 - DNA, 17 bp, Homo sapiens
gatcaccacatcattta

SEQ ID NO: 11688 - DNA, 17 bp, Homo sapiens
gatccctgcacaccatg

SEQ ID NO: 11689 - DNA, 17 bp, Homo sapiens
gatccaagtttctattc

SEQ ID NO: 11690 - DNA, 17 bp, Homo sapiens
gatcttgggtcttatct

SEQ ID NO: 11691 - DNA, 17 bp, Homo sapiens
gatctgtggtacagttt

SEQ ID NO: 11692 - DNA, 17 bp, Homo sapiens
gatctatcatgtatctt

SEQ ID NO: 11693 - DNA, 17 bp, Homo sapiens
gatccgtgagcacttcc

SEQ ID NO: 11694 - DNA, 17 bp, Homo sapiens
gatctgaatatgattta

SEQ ID NO: 11695 - DNA, 17 bp, Homo sapiens
gatcgaaagttgtgtta

SEQ ID NO: 11696 - DNA, 17 bp, Homo sapiens
gatctattcaggaagag

SEQ ID NO: 11697 - DNA, 17 bp, Homo sapiens
gatctgaagaatcttcg

SEQ ID NO: 11698 - DNA, 17 bp, Homo sapiens
gatctaattgtgattca

SEQ ID NO: 11699 - DNA, 17 bp, Homo sapiens
gatctcagctctgtggg

SEQ ID NO: 11700 - DNA, 17 bp, Homo sapiens
gatcttgatacgaatgt

SEQ ID NO: 11701 - DNA, 17 bp, Homo sapiens
gatcttactcatccagt

SEQ ID NO: 11702 - DNA, 17 bp, Homo sapiens
gatcatgcagcttggga

SEQ ID NO: 11703 - DNA, 17 bp, Homo sapiens
gatctgtggcctcattt

SEQ ID NO: 11704 - DNA, 17 bp, Homo sapiens
gatctggttttttgaaa

SEQ ID NO: 11705 - DNA, 17 bp, Homo sapiens
gatcatttgctgcgaat

SEQ ID NO: 11706 - DNA, 17 bp, Homo sapiens
gatcctctgataagcag

SEQ ID NO: 11707 - DNA, 17 bp, Homo sapiens
gatcacttgacgtcaga

SEQ ID NO: 11708 - DNA, 17 bp, Homo sapiens
gatcatcacacacacac

SEQ ID NO: 11709 - DNA, 17 bp, Homo sapiens
gatcttataaagaattt

SEQ ID NO: 11710 - DNA, 17 bp, Homo sapiens
gatcgcggctaactgca

SEQ ID NO: 11711 - DNA, 17 bp, Homo sapiens
gatcttccctctgacag

SEQ ID NO: 11712 - DNA, 17 bp, Homo sapiens
gatccttcctcacctct

SEQ ID NO: 11713 - DNA, 17 bp, Homo sapiens
gatcccttacttcagca

SEQ ID NO: 11714 - DNA, 17 bp, Homo sapiens
gatctctccaccttagc

SEQ ID NO: 11715 - DNA, 17 bp, Homo sapiens
gatctgacaagaccaga

SEQ ID NO: 11716 - DNA, 17 bp, Homo sapiens
gatcttcgagaaatcgt

SEQ ID NO: 11717 - DNA, 17 bp, Homo sapiens
gatcagaaggccacccc

SEQ ID NO: 11718 - DNA, 17 bp, Homo sapiens
gatccccatccaccttc

SEQ ID NO: 11719 - DNA, 17 bp, Homo sapiens
gatctattaccgataaa

SEQ ID NO: 11720 - DNA, 17 bp, Homo sapiens
gatcattagtcacaact

SEQ ID NO: 11721 - DNA, 17 bp, Homo sapiens
gatccattagtctatgt

SEQ ID NO: 11722 - DNA, 17 bp, Homo sapiens
gatcccaagactacaga

SEQ ID NO: 11723 - DNA, 17 bp, Homo sapiens
gatccacccacagctcc

SEQ ID NO: 11724 - DNA, 17 bp, Homo sapiens
gatcatttttgttatct

SEQ ID NO: 11725 - DNA, 17 bp, Homo sapiens
gatcagctgagtctgaa

SEQ ID NO: 11726 - DNA, 17 bp, Homo sapiens
gatcacctatctcagcc

SEQ ID NO: 11727 - DNA, 17 bp, Homo sapiens
gatcctcccacttcatc

SEQ ID NO: 11728 - DNA, 17 bp, Homo sapiens
gatccctggaagcttcc

SEQ ID NO: 11729 - DNA, 17 bp, Homo sapiens
gatcatcttagggaatt

SEQ ID NO: 11730 - DNA, 17 bp, Homo sapiens
gatctgccacagtgcat

SEQ ID NO: 11731 - DNA, 17 bp, Homo sapiens
gatctcctttgaaaatt

SEQ ID NO: 11732 - DNA, 17 bp, Homo sapiens
gatcctttgaggtcagg

SEQ ID NO: 11733 - DNA, 17 bp, Homo sapiens
gatcgtaactgaatcag

SEQ ID NO: 11734 - DNA, 17 bp, Homo sapiens
gatcccatctaggccac

SEQ ID NO: 11735 - DNA, 17 bp, Homo sapiens
gatctacttgaaaggaa

SEQ ID NO: 11736 - DNA, 17 bp, Homo sapiens
gatcactgttattgaaa

SEQ ID NO: 11737 - DNA, 17 bp, Homo sapiens
gatccagcacttaggga

SEQ ID NO: 11738 - DNA, 17 bp, Homo sapiens
gatcctgtttttttttg

SEQ ID NO: 11739 - DNA, 17 bp, Homo sapiens
gatcctcctgtctctac

SEQ ID NO: 11740 - DNA, 17 bp, Homo sapiens
gatctccacagtatctc

SEQ ID NO: 11741 - DNA, 17 bp, Homo sapiens
gatcaaacttcttttat

SEQ ID NO: 11742 - DNA, 17 bp, Homo sapiens
gatcaaattgtttatgg

SEQ ID NO: 11743 - DNA, 17 bp, Homo sapiens
gatcctgctgtttatta

SEQ ID NO: 11744 - DNA, 17 bp, Homo sapiens
gatcccacaaatgaatt

SEQ ID NO: 11745 - DNA, 17 bp, Homo sapiens
gatcagatggtcatagg

SEQ ID NO: 11746 - DNA, 17 bp, Homo sapiens
gatcacttgggttcagg

SEQ ID NO: 11747 - DNA, 17 bp, Homo sapiens
gatctttattatccatt

SEQ ID NO: 11748 - DNA, 17 bp, Homo sapiens
gatcaaactccaagcaa

SEQ ID NO: 11749 - DNA, 17 bp, Homo sapiens
gatcatggattttaaaa

SEQ ID NO: 11750 - DNA, 17 bp, Homo sapiens
gatcatcaggtttccag

SEQ ID NO: 11751 - DNA, 17 bp, Homo sapiens
gatccagaaaaaaagaa

SEQ ID NO: 11752 - DNA, 17 bp, Homo sapiens
gatcccgaagaaacaga

SEQ ID NO: 11753 - DNA, 17 bp, Homo sapiens
gatctgatgtatatttg

SEQ ID NO: 11754 - DNA, 17 bp, Homo sapiens
gatcacgaccttttgat

SEQ ID NO: 11755 - DNA, 17 bp, Homo sapiens
gatccatcattttggcc

SEQ ID NO: 11756 - DNA, 17 bp, Homo sapiens
gatccactttgtggtaa

SEQ ID NO: 11757 - DNA, 17 bp, Homo sapiens
gatccatgattgtacca

SEQ ID NO: 11758 - DNA, 17 bp, Homo sapiens
gatctctccctctgctg

SEQ ID NO: 11759 - DNA, 17 bp, Homo sapiens
gatctctacgactgaag

SEQ ID NO: 11760 - DNA, 17 bp, Homo sapiens
gatcaaaaatgaccaga

SEQ ID NO: 11761 - DNA, 17 bp, Homo sapiens
gatccagtgagagggaa

SEQ ID NO: 11762 - DNA, 17 bp, Homo sapiens
gatcattctgcctctcc

SEQ ID NO: 11763 - DNA, 17 bp, Homo sapiens
gatcatgcaagggaggg

SEQ ID NO: 11764 - DNA, 17 bp, Homo sapiens
gatccattataatatag

SEQ ID NO: 11765 - DNA, 17 bp, Homo sapiens
gatcccaggtatttagg

SEQ ID NO: 11766 - DNA, 17 bp, Homo sapiens
gatcttattttgtaaat

SEQ ID NO: 11767 - DNA, 17 bp, Homo sapiens
gatcagcttcgagacac

SEQ ID NO: 11768 - DNA, 17 bp, Homo sapiens
gatcggtctgcagaaga

SEQ ID NO: 11769 - DNA, 17 bp, Homo sapiens
gatcaatctaacgaggg

SEQ ID NO: 11770 - DNA, 17 bp, Homo sapiens
gatcgcctgagctcaag

SEQ ID NO: 11771 - DNA, 17 bp, Homo sapiens
gatctgagaagacagcc

SEQ ID NO: 11772 - DNA, 17 bp, Homo sapiens
gatcctggctctacact

SEQ ID NO: 11773 - DNA, 17 bp, Homo sapiens
gatcttcaataaggtgg

SEQ ID NO: 11774 - DNA, 17 bp, Homo sapiens
gatctgttcattgtatt

SEQ ID NO: 11775 - DNA, 17 bp, Homo sapiens
gatcaaggcagcaaagt

SEQ ID NO: 11776 - DNA, 17 bp, Homo sapiens
gatcccacctgtacttt

SEQ ID NO: 11777 - DNA, 17 bp, Homo sapiens
gatcccgggtcgtcatc

SEQ ID NO: 11778 - DNA, 17 bp, Homo sapiens
gatccaaaagccatgaa

SEQ ID NO: 11779 - DNA, 17 bp, Homo sapiens
gatcctcacatgtattt

SEQ ID NO: 11780 - DNA, 17 bp, Homo sapiens
gatcataaggttctcca

SEQ ID NO: 11781 - DNA, 17 bp, Homo sapiens
gatcaactgcagcaaga

SEQ ID NO: 11782 - DNA, 17 bp, Homo sapiens
gatcttttctctatata

SEQ ID NO: 11783 - DNA, 17 bp, Homo sapiens
gatctgatgagaacaaa

SEQ ID NO: 11784 - DNA, 17 bp, Homo sapiens
gatctggaatcagactg

SEQ ID NO: 11785 - DNA, 17 bp, Homo sapiens
gatcaggatttccgttt

SEQ ID NO: 11786 - DNA, 17 bp, Homo sapiens
gatctccttcattccat

SEQ ID NO: 11787 - DNA, 17 bp, Homo sapiens
gatcaggaatccaaggc

SEQ ID NO: 11788 - DNA, 17 bp, Homo sapiens
gatcgtctcggccactg

SEQ ID NO: 11789 - DNA, 17 bp, Homo sapiens
gatccaaatctgtaagg

SEQ ID NO: 11790 - DNA, 17 bp, Homo sapiens
gatctaatggttttaca

SEQ ID NO: 11791 - DNA, 17 bp, Homo sapiens
gatctgcgcatctaaaa

SEQ ID NO: 11792 - DNA, 17 bp, Homo sapiens
gatcaccagtgagtagg

SEQ ID NO: 11793 - DNA, 17 bp, Homo sapiens
gatcacttgcggtcaga

SEQ ID NO: 11794 - DNA, 17 bp, Homo sapiens
gatctcgcagatgtggg

SEQ ID NO: 11795 - DNA, 17 bp, Homo sapiens
gatctcaagagcaacaa

SEQ ID NO: 11796 - DNA, 17 bp, Homo sapiens
gatcattagcaagtaga

SEQ ID NO: 11797 - DNA, 17 bp, Homo sapiens
gatcttctttcttttac

SEQ ID NO: 11798 - DNA, 17 bp, Homo sapiens
gatctatcctctacctg

SEQ ID NO: 11799 - DNA, 17 bp, Homo sapiens
gatccatggggaatttc

SEQ ID NO: 11800 - DNA, 17 bp, Homo sapiens
gatccttactctgggcc

SEQ ID NO: 11801 - DNA, 17 bp, Homo sapiens
gatcagtgacagaagtg

SEQ ID NO: 11802 - DNA, 17 bp, Homo sapiens
gatccccctgccctggc

SEQ ID NO: 11803 - DNA, 17 bp, Homo sapiens
gatcaaaaagtttgata

SEQ ID NO: 11804 - DNA, 17 bp, Homo sapiens
gatccaccctcctcagt

SEQ ID NO: 11805 - DNA, 17 bp, Homo sapiens
gatctggttggaatgtt

SEQ ID NO: 11806 - DNA, 17 bp, Homo sapiens
gatccagaagtcttact

SEQ ID NO: 11807 - DNA, 17 bp, Homo sapiens
gatctggactgactgtg

SEQ ID NO: 11808 - DNA, 17 bp, Homo sapiens
gatcagtgatttataaa

SEQ ID NO: 11809 - DNA, 17 bp, Homo sapiens
gatcgaaagtgcgcggg

SEQ ID NO: 11810 - DNA, 17 bp, Homo sapiens
gatcagaaatgtctcct

SEQ ID NO: 11811 - DNA, 17 bp, Homo sapiens
gatctcatgagatttac

SEQ ID NO: 11812 - DNA, 17 bp, Homo sapiens
gatctcatctgatttgt

SEQ ID NO: 11813 - DNA, 17 bp, Homo sapiens
gatcttctttgtatcct

SEQ ID NO: 11814 - DNA, 17 bp, Homo sapiens
gatcgtaaggaaggatg

SEQ ID NO: 11815 - DNA, 17 bp, Homo sapiens
gatctcagaaagttctc

SEQ ID NO: 11816 - DNA, 17 bp, Homo sapiens
gatccaccttcttgtct

SEQ ID NO: 11817 - DNA, 17 bp, Homo sapiens
gatctactggcaggttt

SEQ ID NO: 11818 - DNA, 17 bp, Homo sapiens
gatcctggggctggggc

SEQ ID NO: 11819 - DNA, 17 bp, Homo sapiens
gatctgactggccagtt

SEQ ID NO: 11820 - DNA, 17 bp, Homo sapiens
gatctctcatcttaact

SEQ ID NO: 11821 - DNA, 17 bp, Homo sapiens
gatccccaacaacgtga

SEQ ID NO: 11822 - DNA, 17 bp, Homo sapiens
gatccaaatcctgggcc

SEQ ID NO: 11823 - DNA, 17 bp, Homo sapiens
gatctatcagtgtgata

SEQ ID NO: 11824 - DNA, 17 bp, Homo sapiens
gatcactgaagttctgg

SEQ ID NO: 11825 - DNA, 17 bp, Homo sapiens
gatcttaaatttgtggt

SEQ ID NO: 11826 - DNA, 17 bp, Homo sapiens
gatccaggttaaggaag

SEQ ID NO: 11827 - DNA, 17 bp, Homo sapiens
gatccaaaataaggaaa

SEQ ID NO: 11828 - DNA, 17 bp, Homo sapiens
gatccacacaaatatac

SEQ ID NO: 11829 - DNA, 17 bp, Homo sapiens
gatctgaggttgactgt

SEQ ID NO: 11830 - DNA, 17 bp, Homo sapiens
gatccccagtttctcag

SEQ ID NO: 11831 - DNA, 17 bp, Homo sapiens
gatcctcaccctgacat

SEQ ID NO: 11832 - DNA, 17 bp, Homo sapiens
gatctactctgccaatt

SEQ ID NO: 11833 - DNA, 17 bp, Homo sapiens
gatcagtcaaacatgca

SEQ ID NO: 11834 - DNA, 17 bp, Homo sapiens
gatccacaggctgtcct

SEQ ID NO: 11835 - DNA, 17 bp, Homo sapiens
gatcatcatttaaaaat

SEQ ID NO: 11836 - DNA, 17 bp, Homo sapiens
gatcctgcggggtgggc

SEQ ID NO: 11837 - DNA, 17 bp, Homo sapiens
gatctttctccttttcg

SEQ ID NO: 11838 - DNA, 17 bp, Homo sapiens
gatctctggaggcttcc

SEQ ID NO: 11839 - DNA, 17 bp, Homo sapiens
gatccatggaataatat

SEQ ID NO: 11840 - DNA, 17 bp, Homo sapiens
gatcgcgtcactgcgct

SEQ ID NO: 11841 - DNA, 17 bp, Homo sapiens
gatccactaacctcttc

SEQ ID NO: 11842 - DNA, 17 bp, Homo sapiens
gatctgccaaggctgcc

SEQ ID NO: 11843 - DNA, 17 bp, Homo sapiens
gatctgacaggaagttc

SEQ ID NO: 11844 - DNA, 17 bp, Homo sapiens
gatcaaatgttgtttaa

SEQ ID NO: 11845 - DNA, 17 bp, Homo sapiens
gatctgttcggtcctgt

SEQ ID NO: 11846 - DNA, 17 bp, Homo sapiens
gatctactttggtggtt

SEQ ID NO: 11847 - DNA, 17 bp, Homo sapiens
gatccagttcaggttcc

SEQ ID NO: 11848 - DNA, 17 bp, Homo sapiens
gatcagaaccagttttc

SEQ ID NO: 11849 - DNA, 17 bp, Homo sapiens
gatctcattccagaaaa

SEQ ID NO: 11850 - DNA, 17 bp, Homo sapiens
gatccagttgggtatgg

SEQ ID NO: 11851 - DNA, 17 bp, Homo sapiens
gatccccggccctggca

SEQ ID NO: 11852 - DNA, 17 bp, Homo sapiens
gatcgcaccccagcctg

SEQ ID NO: 11853 - DNA, 17 bp, Homo sapiens
gatcagtcttcccactc

SEQ ID NO: 11854 - DNA, 17 bp, Homo sapiens
gatcttactggaaaact

SEQ ID NO: 11855 - DNA, 17 bp, Homo sapiens
gatctgagagctgggcg

SEQ ID NO: 11856 - DNA, 17 bp, Homo sapiens
gatcactgtagccctga

SEQ ID NO: 11857 - DNA, 17 bp, Homo sapiens
gatcacaatccaggtgc

SEQ ID NO: 11858 - DNA, 17 bp, Homo sapiens
gatccacccccttcggc

SEQ ID NO: 11859 - DNA, 17 bp, Homo sapiens
gatcaggcacggtgaat

SEQ ID NO: 11860 - DNA, 17 bp, Homo sapiens
gatcctaggttctaggg

SEQ ID NO: 11861 - DNA, 17 bp, Homo sapiens
gatctaaagcaatagct

SEQ ID NO: 11862 - DNA, 17 bp, Homo sapiens
gatcaccagccatcagg

SEQ ID NO: 11863 - DNA, 17 bp, Homo sapiens
gatctgaggcaatagag

SEQ ID NO: 11864 - DNA, 17 bp, Homo sapiens
gatccatcctttgaatt

SEQ ID NO: 11865 - DNA, 17 bp, Homo sapiens
gatctattctgaagcaa

SEQ ID NO: 11866 - DNA, 17 bp, Homo sapiens
gatctgcctctatccga

SEQ ID NO: 11867 - DNA, 17 bp, Homo sapiens
gatctttatgcctttac

SEQ ID NO: 11868 - DNA, 17 bp, Homo sapiens
gatctattgcacaacat

SEQ ID NO: 11869 - DNA, 17 bp, Homo sapiens
gatcagttcttttctga

SEQ ID NO: 11870 - DNA, 17 bp, Homo sapiens
gatcatttggtttttct

SEQ ID NO: 11871 - DNA, 17 bp, Homo sapiens
gatctgtttttggagga

SEQ ID NO: 11872 - DNA, 17 bp, Homo sapiens
gatcaggtgtaataatt

SEQ ID NO: 11873 - DNA, 17 bp, Homo sapiens
gatcattggttccagtt

SEQ ID NO: 11874 - DNA, 17 bp, Homo sapiens
gatccaagtgctcattt

SEQ ID NO: 11875 - DNA, 17 bp, Homo sapiens
gatccagtggctttttc

SEQ ID NO: 11876 - DNA, 17 bp, Homo sapiens
gatcactatcacgaaat

SEQ ID NO: 11877 - DNA, 17 bp, Homo sapiens
gatcatgcaattctgtc

SEQ ID NO: 11878 - DNA, 17 bp, Homo sapiens
gatctgaccccgatttc

SEQ ID NO: 11879 - DNA, 17 bp, Homo sapiens
gatcaatctcaatgata

SEQ ID NO: 11880 - DNA, 17 bp, Homo sapiens
gatcgctgttcctcaga

SEQ ID NO: 11881 - DNA, 17 bp, Homo sapiens
gatcatcttcaccattt

SEQ ID NO: 11882 - DNA, 17 bp, Homo sapiens
gatcttacctattatta

SEQ ID NO: 11883 - DNA, 17 bp, Homo sapiens
gatcagctttgctgttg

SEQ ID NO: 11884 - DNA, 17 bp, Homo sapiens
gatccagctggaggcct

SEQ ID NO: 11885 - DNA, 17 bp, Homo sapiens
gatctctctctgaggaa

SEQ ID NO: 11886 - DNA, 17 bp, Homo sapiens
gatctgtactgtttcag

SEQ ID NO: 11887 - DNA, 17 bp, Homo sapiens
gatctgctcttctcagc

SEQ ID NO: 11888 - DNA, 17 bp, Homo sapiens
gatccatccagatgagg

SEQ ID NO: 11889 - DNA, 17 bp, Homo sapiens
gatctaggaatactgaa

SEQ ID NO: 11890 - DNA, 17 bp, Homo sapiens
gatctaagataagttgt

SEQ ID NO: 11891 - DNA, 17 bp, Homo sapiens
gatccgcaagttggaac

SEQ ID NO: 11892 - DNA, 17 bp, Homo sapiens
gatcctatcagcccagt

SEQ ID NO: 11893 - DNA, 17 bp, Homo sapiens
gatcagagtattgtctc

SEQ ID NO: 11894 - DNA, 17 bp, Homo sapiens
gatcccaggttccagca

SEQ ID NO: 11895 - DNA, 17 bp, Homo sapiens
gatctcctttttccaga

SEQ ID NO: 11896 - DNA, 17 bp, Homo sapiens
gatcagcatattctttt

SEQ ID NO: 11897 - DNA, 17 bp, Homo sapiens
gatcttgagagggggtt

SEQ ID NO: 11898 - DNA, 17 bp, Homo sapiens
gatccacagctgccgcc

SEQ ID NO: 11899 - DNA, 17 bp, Homo sapiens
gatcattttcttttgtt

SEQ ID NO: 11900 - DNA, 17 bp, Homo sapiens
gatctcataaaggaagt

SEQ ID NO: 11901 - DNA, 17 bp, Homo sapiens
gatcacaaggaatcagg

SEQ ID NO: 11902 - DNA, 17 bp, Homo sapiens
gatcaaagctgatggag

SEQ ID NO: 11903 - DNA, 17 bp, Homo sapiens
gatcataataaaacatt

SEQ ID NO: 11904 - DNA, 5384 bp, Homo sapiens
aaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacatt

SEQ ID NO: 11905 - DNA, 5881 bp, Homo sapiens
ggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 11906 - DNA, 1584 bp, Homo sapiens
gcgtcccccacaccacagacccgcgccgccgacgacccagcagccgccatgcgtctgctccgaggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcagagttcttcagatgctatatatttggcaaggcatgttggtttgcgtgtgggaatcccaaaggagaccccagctctcacgattaataggctctgtggttctggttttcagtccattgtgaatggatgtcaggaaatttgtgttaaagaagctgaagttgttttatgtggaggaaccgaaagcatgagccaagctccctactgtgtcagaaatgtgcgttttggaaccaagcttggatcagatatcaagctggaagattctttatgggtatcattaacagatcagcatgtccagctccccatggcaatgactgcagagaatcttactgtaaaacacaaaataagcagagaagaatgtgacaaatatgccctgcagtcacagcagagatggaaagctgctaatgatgctggctactttaatgatgaaatggcaccaattgaagtgaagacaaagaaaggaaaacagacaatgcaggtagacgagcatgctcggccccaaaccaccctggaacagttacagaaacttcctccagtattcaagaaagatggaactgttactgcagggaatgcatcgggtgtagctgatggtgctggagctgttatcatagctagtgaagatgctgttaagaaacataacttcacaccactggcaagaattgtgggctactttgtatctggatgtgatccctctatcatgggtattggtcctgtccctgctatcagtggggcactgaagaaagcaggactgagtcttaaggacatggatttggtagaggtgaatgaagcttttgctccccagtacttggctgttgagaggagtttggatcttgacataagtaaaaccaatgtgaatggaggagccattgctttgggtcacccactgggaggatctggatcaagaattactgcacacctggttcacgaattaaggcgtcgaggtggaaaatatgccgttggatcagcttgcattggaggtggccaaggtattgctgtcatcattcagagcacagcctgaagagaccagtgagctcactgtgacccatccttactctacttggccaggccacagtaaaacaagtgaccttcagagcagctgccacaactggccatgccctgccattgaaacagtgattaagtttgatcaagccatggtgacacaaaaatgcattgatcatgaataggagcccatgctagaagtacattctctcagatttgaaccagtgaaatatgatgtatttctgagctaaaactcaactatagaagacattaaaagaaatcgtattcttgccaagtaaccaccacttctgccttagataatatgattataaggaaatcaaataaatgttgccttaacttc

SEQ ID NO: 11907 - DNA, 5244 bp, Homo sapiens
tttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggactgattgtgtagaaaaaaaagacagccctgaagtatatttttgttgctgtgagggcaatatgtgtaatgaaaagttttcttattttccggagatggaagtcacacagcccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaagggttcactatcagactttcttaaggctaatgtggtctcttggaatgaactgtgtcatattgcagaaaccatggctagaggattggcatatttacatgaggatatacctggcctaaaagatggccacaaacctgccatatctcacagggacatcaaaagtaaaaatgtgctgttgaaaaacaacctgacagcttgcattgctgactttgggttggccttaaaatttgaggctggcaagtctgcaggcgatacccatggacaggttggtacccggaggtacatggctccagaggtattagagggtgctataaacttccaaagggatgcatttttgaggatagatatgtatgccatgggattagtcctatgggaactggcttctcgctgtactgctgcagatggacctgtagatgaatacatgttgccatttgaggaggaaattggccagcatccatctcttgaagacatgcaggaagttgttgtgcataaaaaaaagaggcctgttttaagagattattggcagaaacatgctggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggta

SEQ ID NO: 11908 - DNA, 4358 bp, Homo sapiens
gacgctcgaggggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatataaaaaaaaaaa

SEQ ID NO: 11909 - DNA, 4454 bp, Homo sapiens
gacgctcgaggggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatataaaaaaaaaaa

SEQ ID NO: 11910 - DNA, 4195 bp, Homo sapiens
gagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatataaaaaaaaaaa

SEQ ID NO: 11911 - DNA, 5538 bp, Homo sapiens
gcggcacagagccgcggcttgctttcaggacacgggtcgctggcgggttaggtggctgcgtggccgcctcacttcgcgcacgcgccgctaggctgggggagttgatttgcactgctccgggtgtcggctccggcgggacgggcggttctgcgtacccctctccagtgtcaacctggggctgaatcttcaacctgtcaaagccttcttaattatgtctgagaaaaggatcctgattgagtcaatgctttgcattctcagtcctctgcataaagctgagagatgcctacagctgagagtgaagcaaaagtaaaaaccaaagttcgctttgaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacaaacaaggaaagccaaataaaaaggtgataaagacggtgccccagttgactacacaagacctgaaaccggaaactcctgagaataaggttgattctacacaccagaaaacacatacaaagccacagccaggcgttgatcatcagaaaagtgagaaggcaaatgagggaagagaagagactgatttagaagaggatgaagaattgatgcaagcatatcagtgccatgtaactgaagaaatggcaaaggagattaagaggaaaataagaaagaaactgaaagaacagttgacttactttccctcagatactttattccatgatgacaaactaagcagtgaaaaaaggaaaaagaaaaaggaagttccagtcttctctaaagctgaaacaagtacattgaccatctctggtgacacagttgaaggtgaacaaaagaaagaatcttcagttagatcagtttcttcagattctcatcaagatgatgaaataagctcaatggaacaaagcacagaagacagcatgcaagatgatacaaaacctaaaccaaaaaaaacaaaaaagaagactaaagcagttgcagataataatgaagatgttgatggtgatggtgttcatgaaataacaagccgagatagcccggtttatcccaaatgtttgcttgatgatgaccttgtcttgggagtttacattcaccgaactgatagacttaagtcagattttatgatttctcacccaatggtaaaaattcatgtggttgatgagcatactggtcaatatgtcaagaaagatgatagtggacggcctgtttcatcttactatgaaaaagagaatgtggattatattcttcctattatgacccagccatatgattttaaacagttaaaatcaagacttccagagtgggaagaacaaattgtatttaatgaaaattttccctatttgcttcgaggctctgatgagagtcctaaagtcatcctgttctttgagattcttgatttcttaagcgtggatgaaattaagaataattctgaggttcaaaaccaagaatgtggctttcggaaaattgcctgggcatttcttaagcttctgggagccaatggaaatgcaaacatcaactcaaaacttcgcttgcagctatattacccacctactaagcctcgatccccattaagtgttgttgaggcatttgaatggtggtcaaaatgtccaagaaatcattacccatcaacactgtacgtaactgtaagaggactgaaagttccagactgtataaagccatcttaccgctctatgatggctcttcaggaggaaaaaggtaaaccagtgcattgtgaacgtcaccatgagtcaagctcagtagacacagaacctggattagaagagtcaaaggaagtaataaagtggaaacgactccctgggcaggcttgccgtatcccaaacaaacacctcttctcactaaatgcaggagaacgaggatgtttttgtcttgatttctcccacaatggaagaatattagcagcagcttgtgccagccgggatggatatccaattattttatatgaaattccttctggacgtttcatgagagaattgtgtggccacctcaatatcatttatgatctttcctggtcaaaagatgatcactacatccttacttcatcatctgatggcactgccaggatatggaaaaatgaaataaacaatacaaatactttcagagttttacctcatccttcttttgtttacacggctaaattccatccagctgtaagagagctagtagttacaggatgctatgattccatgatacggatatggaaagttgagatgagagaagattctgccatattggtccgacagtttgatgttcacaaaagttttatcaactcactttgttttgatactgaaggtcatcatatgtattcaggagattgtacaggggtgattgttgtttggaatacctatgtcaagattaatgatttggaacattcagtgcaccactggactataaataaggaaattaaagaaactgagtttaagggaattccaataagttatttggagattcatcccaatggaaaacgtttgttaatccataccaaagacagtactttgagaattatggatctccggatattagtagcaaggaagtttgtaggagcagcaaattatcgggagaagattcatagtactttgactccatgtgggacttttctgtttgctggaagtgaggatggtatagtgtatgtttggaacccagaaacaggagaacaagtagccatgtattctgacttgccattcaagtcacccattcgagacatttcttatcatccatttgaaaatatggttgcattctgtgcatttgggcaaaatgagccaattcttctgtatatttacgatttccatgttgcccagcaggaggctgaaatgttcaaacgctacaatggaacatttccattacctggaatacaccaaagtcaagatgccctatgtacctgtccaaaactaccccatcaaggctcttttcagattgatgaatttgtccacactgaaagttcttcaacgaagatgcagctagtaaaacagaggcttgaaactgtcacagaggtgatacgttcctgtgctgcaaaagtcaacaaaaatctctcatttacttcaccaccagcagtttcctcacaacagtctaagttaaagcagtcaaacatgctgaccgctcaagagattctacatcagtttggtttcactcagaccgggattatcagcatagaaagaaagccttgtaaccatcaggtagatacagcaccaacggtagtggctctttatgactacacagcgaatcgatcagatgaactaaccatccatcgcggagacattatccgagtgtttttcaaagataatgaagactggtggtatggcagcataggaaagggacaggaaggttattttccagctaatcatgtggctagtgaaacactgtatcaagaactgcctcctgagataaaggagcgatcccctcctttaagccctgaggaaaaaactaaaatagaaaaatctccagctcctcaaaagcaatcaatcaataagaacaagtcccaggacttcagactaggctcagaatctatgacacattctgaaatgagaaaagaacagagccatgaggaccaaggacacataatggatacacggatgaggaagaacaagcaagcaggcagaaaagtcactctaatagagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggcaggtggatcacctaaggtcaggagttcaacaacaccagcctgaccaacatggtgaaaccccatctctactaaaaatacaaaaatcagccgggtctcatggcaggcacctgtaatcccatctactgaggcaggagaattgcttgacccaggaggcagaggttgcagtgagccaagatcacgccattgcactccagcctgggggacagagcaagactctatctccaaaaaacaaaaaagataagcagctttagaatatggcgcattcaaaacagtctcagtaacaaagacattaaaagaaaacaatttactttctaattaaaattttgtgtttcttaagatcaaatcatataggtaacttcatagacctaaattaaaagtgatttttggctggactggcaacaatgttcccaatgtctttactttttaaaaaaggcttttcatatttaagcacatacctattttgtagacttacattgtttaatatttattttaatcttaatatttttacattattatattgcattatttattttttctaagttccagaataatagtgtcattattatagactatatgttttgaagtttgatattataatgggatattcattttttgttcttttcttgactcctttctcaagtgtgtgataaggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaagcctacagccatccgcccaaaagtctgttctgatggcactgagttttcattgttctggatgtataagtctgtgtgtcaggtacagctgggcccagccagcttgagtcactcttgtacaagcttgtttttttctgtcttgtgaatgcacttgataatttaaaaataaaaatatctgtttctctgcaaaaaaaaaa

SEQ ID NO: 11912 - DNA, 5131 bp, Homo sapiens
gtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgagcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgta

SEQ ID NO: 11913 - DNA, 5170 bp, Homo sapiens
gtttcctgtcgccgtcgttgcccgggccatggcgacctgcatttggctgcggagctgtggggcccggcgcctcgggtcgacgtttccaggctgccgcctccgcccccgcgccggcggcctggtccctgcctccgggcctgcgcccggcccggcccagctccgctgctacgctgggcgcctggcgggcctctctgcggcgctgctgcgcaccgacagcttcgtgggcggccgctggctcccggccgccgccaccttccccgtgcaagacccggccagcggcgccgctctgggcatggtagccgactgcggggtgcgagaggcccgcgccgccgtgcgcgctgcctacgaggctttctgccgctggagggaggtctccgccaaggagaggagttcattacttcggaagtggtacaatttaatgatacaaaataaggatgaccttgccagaataatcacagctgaaagtggaaagccactgaaggaggcacatggagaaattctctattccgcctttttcctagagtggttctctgaggaagcccgccgtgtttacggagacattatccacaccccggcaaaggacaggcgggccctggtcctcaagcagcccataggcgtggctgcagtcatcaccccgtggaatttccccagtgccatgatcacccggaaggtgggggccgccctggcagccggctgtactgtcgtggtgaagcctgccgaagacacgcccttctccgccctggccctggctgaggtaaatcagggatttcttcttgatttggatccattgttgcttgcaagccaggctgggattccttcaggtgtatacaatgttattccctgttctcgaaagaatgccaaggaagtaggggaggcaatttgtactgatcctctggtgtccaaaatttcctttactggttcaacaactacaggaaagatcctgttgcaccacgcagcaaactctgtgaaaagggtctctatggagctgggcggccttgctccatttatagtatttgacagtgccaacgtggaccaggctgtagcaggggccatggcatctaaatttaggaacactggacagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtggagaaacaggtgaatgatgccgtttctaaaggtgccaccgttgtgacaggtggaaaacgacaccaacttggaaaaaatttctttgagcctaccctgctgtgcaatgtcacccaggacatgctgtgcactcatgaagagactttcgggcctctggcaccagttatcaagttcgatacagaggaggaggctatagcaatcgctaacgcagctgatgttgggttagcaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagtggcatggcctggctccttccctgagtggccttgttgccttgggcgtgtgttcagcacctcccatcccatggatacagtggagattccatacaggccttacttagctccttgcgatactgtgagccagagagaaagtaaaagcacttcacaaaaaaatgaaaattctaaggacatacaagagccattgttacgagcagcaccgcccagcccttccttgcctactgtcagtggctttgccaagatgggaggaggccagtgcccacttgcccaccgacctgagcctgagtaagtggctgtcacctgagcctgttctttctgtcctggtgtggtgctgctccctcacctccaaaagagcaaaagtactttcaccacagtcaacccaaaagggaaagaatttctgtaattgccaacccactttgtagaagaggcatgagcccttgaatttcaggcaccttttatctaatgagagtttttacagctcatcattcaaataacgcacaaaaaacaaaagccgctatgaccggcgttgcctctcactttgaaagaaagactccgtaatcttaaacagatgcaaatccaattaggcggccaagtaggtggagacgaagcaccttcctttccccatctctgtctgtgtagactccacttacatcttgtggttattctgggttgtggaaggaaaatgtgaatgaaagtagtgctggatgcaattactcctgaaccccacctaggatttaacatccctcattgagccactgggaagctatggttgagtaactaaaggtctggcaagaccctgggcacacagggagctgcctagcatctggcctggagtgtactagccacattcccaaggtcccaaggagaaggaagagctgaaattcatctcctagtgacagtgccccggccctgtcaagaatcacatactcagcattttgacagttaatgtcttctctttatttgtgtagtttttaggtggttttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaacttcctccagctatgcagggattctcattaaagagctgatctgcatctgtttatccattttagtagcttttaaatatgattttatgtgaagtgccatttctttattctactaaagagagacagcagaaataaagatcagaagcaaatgtgagcaaatctgttttactgttaacttcaattatgaacttgaaattgtgccacatgactttttcctctaaaaactggatcctagtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgta

SEQ ID NO: 11914 - DNA, 3287 bp, Homo sapiens
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttggctgaatctgaacaggctccacccacagagccaaaagcagaggagcctctggctgctgtcacacctgccgttggtctggaccttggaatggacactcgggctgaggagccagtggaggaggcagtgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaaaaaaaaaaaaaaaaaa

SEQ ID NO: 11915 - DNA, 3161 bp, Homo sapiens
cccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcctccaaaagctggggaaagctgatgagacaaaagacgaacagttcgaagaatatgtccagaacttcaaacggcaagaagcagagggtaccagacttcagcgagaactccgaggatatttagcagcaatcaaaggcatgcaggaggcctccatgaagctcacagagtcgctgcatgaagtctatgagcctgactggtatgggcgggaagatgtgaaaatggttggtgagaaatgtgatgtgctgtgggaagacttccatcaaaaactcgtggatgggtccttgctaacactggatacctacctggggcaatttcctgacataaagaatcgcatcgccaagcgcagcaggaagctagtggactatgacagtgcccgccaccatctggaagctctgcagagctccaagaggaaggatgagagtcgaatctctaaggcagaagaagaatttcagaaagcacagaaagtgtttgaagagtttaacgttgacttacaagaagagttaccatcattatggtcaagacgagttggattttatgttaatactttcaaaaacgtctccagccttgaagccaagtttcataaggaaattgcggtgctttgccacaaactgtatgaagtgatgacaaaactgggtgaccagcacgccgacaaggccttcaccatccaaggagcgcccagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacagacaaggaaagggcctcctgtcccacctctacctaaagtcaccccgacaaaggaactgcagcaggagaacatcatcagtttctttgaggacaactttgttccagaaatcagtgtgacaacaccttcccagaatgaagtccctgaggtgaagaaagaggagactttgctggatctggactttgatcctttcaagcccgaggtgacacctgcaggttctgctggagtgacccactcacccatgtctcagacattgccctgggacctatggacgacaagcactgatttggtacagccggcttctggtggttcatttaatggattcacacagccccaggatacttcattattcacaatgcagacagaccagagtatgatctgcaacttgatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtggaaacactgcatgattttgaggcagcaaattctgatgaacttaccttacaaaggggtgatgtggtgctggtggtcccctcagattcagaagctgatcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaaaaaaaaaaaaaaaaaa

SEQ ID NO: 11916 - DNA, 7911 bp, Homo sapiens
tccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaaaaaaaaaaaaaaaaaa

SEQ ID NO: 11917 - DNA, 2905 bp, Homo sapiens
ggctaaggtgcgcgtgctcgctggttctaaccctcctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaagtgtgaatatcagccactgttatttgctgtgagtcgaagaaaagtgaaaatggtggaatttttattaaagaaaaaagcaaatgtaaatgccattgattatcttggcagatcagccctcatacatgctgttactcttggagaaaaagatatagtcattcttcttctgcagcacaatattgatgtgctttctcgagatgcgtttcgaaagattgcaggagattatgccattgaggctaagaatagagtcatttttgatctaatttatgaatacgaaagaaagagatatgaagatcttcctataaatagcaatccagtgtcttctcagaaacaaccagccttgaaggctacaagtggcaaggaagattctatttcaaatatagccacagaaataaaggatggacaaaaatctgggacagtgtcttctcagaaacaaccggccttgaaggatacaagtgacaaggatgattctgtttcgaacacagccacagaaataaaagatgaacaaaaatctgggacagtgcttcctgctgttgaacagtgtttaaacaggagtctctacagacctgatgctgttgcacagcctgtgacagagaatgagttttctttggaatctgagattatttcaaaactatacatcccaaagagaaagattatttctccacgatctataaaagatgtgcttcctcctattgaagaggctgttgacaggtgtctctacctactggaccgttttgcacagcctgtgacaaaggataagtttgctttggaatctgagaatatttcagaaccatactttacgaacagaaggactatttctcaacaatctgcagaaaatttagatgctgcatgtggcattgacaaaacagaaaatggaaacatgtttgaagaccaaaatgttgataaggaaggaaaagcactaccagcaactggacaaaaagcaaatgtgtctcctgagcaaccgcctttattcacgaatcttctgagcgacctcctttatccacgcttactctgaaagaggcagatcccagttcaaaagcagccatgagaaggaaggattcaccacctccaggaaaagtgtcttctcagaaacaaccagctgagaaggctacaagtgacgacaaagattctgtttcaaatatagccacagaaataaaggagggaccaatatctgggacagtgtcttctcagaaacaaccagctgagaaggctacaagtgacgagaaagattctgtttcaaacatagccacagaaataaagaagggacaacaatctgggacagtgtctcctcagaaacaatcggcccggaaggttatatttaaaaagaaagtttctcttttgaatattgccacaagaataatgggtggtgggaaatctggaacagtgtcttctcagaaacagccagcctcaaaggctacaagtgacaagacagattctgctttgaatatagctacagaaataaaggatggactacagtgtgggacagtgtcttctcagaaacaaccagccttgaaggctacaactgacgaggaagactctgtttcgaatatagccacagaaataaaggatggagaaaaatctgggacagtgtcttctcagaaacaaccagccttgaaggctacaactgatgagaaagattctgtttcgaacatagccacagaaataaaggatggagaaaaatctgggacagtgtcttctcagaaaccaccagccttgacggctacaagtgacgaggaaggttctgttttgagtatagccagagaaaacaaggatggagaaaaatctaggacagtgtcttctcggaaaaaaccagcctcgaaggctacaagtgatgagaaggattctttttcgaatataaccagaggaaaaaaggatggagaaatatctaggaaagtgtcttctcagaaaccaccaaccttgaagtgtcttctgagaaaccaccaggcttgaagtgtcttctcggaaaaaaccatccttggaggccacaagtgatgagaaggattctttttcgaatataaccagagaaaaaaaggatggagaaatatctaggaaagtgtcttctcagaaaccaccagccttgaagggtacaagtgacgaggaagattctgttttgggtatagccagagaaaacaaggatggagaaaaatctaggacagtgtcttctgagaaaccaccaggcttgaaggctacaagtgatgagaaagattctgttttgaatatagccagaggaaaaaa

SEQ ID NO: 11918 - DNA, 2297 bp, Homo sapiens
ggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaaaaaaaaaaaaaaa

SEQ ID NO: 11919 - DNA, 2450 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 11920 - DNA, 2447 bp, Homo sapiens
ggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggcca

SEQ ID NO: 11921 - DNA, 4081 bp, Homo sapiens
gtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaaaaaaaaaaaaaaaaaa

SEQ ID NO: 11922 - DNA, 1354 bp, Homo sapiens
actgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttcaaa

SEQ ID NO: 11923 - DNA, 1402 bp, Homo sapiens
actgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttcaaa

SEQ ID NO: 11924 - DNA, 1321 bp, Homo sapiens
actgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttcaaa

SEQ ID NO: 11925 - DNA, 1378 bp, Homo sapiens
actgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttcaaa

SEQ ID NO: 11926 - DNA, 2476 bp, Homo sapiens
aagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccaatttgttgcccatcacgcgcagcaatgtggagtggcctcttcactcacttaacagaatcttggaataattttaagggtctagatccaaattatacaacatggatggatgtcatggagaggcatggctaccgaacacagaaatttgggaaactggactatacttcaggacatcactccattagtaatcgtgtggaagcgtggacaagagatgttgctttcttactcagacaagaaggcaggcccatggttaatcttatccgtaacaggactaaagtcagagtgatggaaagggattggcagaatacagacaaagcagtaaactggttaagaaaggaagcaattaattacactgaaccatttgttatttacttgggattaaatttaccacacccttacccttcaccatcttctggagaaaattttggatcttcaacatttcacacatctctttattggcttgaaaaagtgtctcatgatgccatcaaaatcccaaagtggtcacctttgtcagaaatgcaccctgtagattattactcttcttatacaaaaaactgcactggaagatttacaaaaaaagaaattaagaatattagagcattttattatgctatgtgtgctgagacagatgccatgcttggtgaaattattttggcccttcatcaattagatcttcttcagaaaactattgtcatatactcctcagaccatggagagctggccatggaacatcgacagttttataaaatgagcatgtacgaggctagtgcacatgttccgcttttgatgatgggaccaggaattaaagccggcctacaagtatcaaatgtggtttctcttgtggatatttaccctaccatgcttgatattgctggaattcctctgcctcagaacctgagtggatactctttgttgccgttatcatcagaaacatttaagaatgaacataaagtcaaaaacctgcatccaccctggattctgagtgaattccatggatgtaatgtgaatgcctccacctacatgcttcgaactaaccactggaaatatatagcctattcggatggtgcatcaatattgcctcaactctttgatctttcctcggatccagatgaattaacaaatgttgctgtaaaatttccagaaattacttattctttggatcagaagcttcattccattataaactaccctaaagtttctgcttctgtccaccagtataataaagagcagtttatcaagtggaaacaaagtataggacagaattattcaaacgttatagcaaatcttaggtggcaccaagactggcagaaggaaccaaggaagtatgaaaatgcaattgatcagtggcttaaaacccatatgaatccaagagcagtttgaacaaaaagtttaaaaatagtgttctagagatacatataaatatattacaagatcataattatgtattttaaatgaaacagttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaaaaataaaaataaaataataataattaccaatttttcattattttgtaagaatgtagtgtattttaagataaaatgccaatgattataaaatcacatattttcaaaaatggttattatttaggcctttgtacaatttctaacaatttagtggaagtatcaaaaggattgaagcaaatactgtaacagttatgttcctttaaataatagagaatataaaatattgtaataatatgtatcataaaatagttgtatgtgagcatttgatggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11927 - DNA, 2396 bp, Homo sapiens
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccctggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggaaaaaaaaaaaaaaaaaaaa

SEQ ID NO: 11928 - DNA, 13147 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgagatcctgaaacaattaaacatctagatcggcattcagattccaaacaaggaaaatatttgaattgggatgctgtttttagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatgtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacagtaattttcctcatcttgtactggagaaaattcttgtgagtctcactatgaaaaactgtaaagctgcaatgaattttttccaaagcgtgccagaatgtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgagattacaaattcagaaactcttgtccggtgttcacgtcttttggtgggtgtccttggctgctactgttacatgggtgtaatagctgaagaggaagcatataagtcagaattattccagaaagccaagtctctaatgcaatgtgcaggagaaagtatcactctgtttaaaaataagacaaatgaggaattcagaattggttccttgagaaatatgatgcagctatgtacacgttgcttgagcaactgtaccaagaagagtccaaataagattgcatctggctttttcctgcgattgttaacatcaaagctaatgaatgacattgcagatatttgtaaaagtttagcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatgtatctaatgcttttaaaggagcttcctggagaagagtaccccttgccaatggaagatgttcttgaacttctgaaaccactatccaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggcatctaacaaaggagaggaaatatatattctctgtaagaatggccctagtaaattgccttaaaactttgcttgaggctgatccttattcaaaatgggccattcttaatgtaatgggaaaagactttcctgtaaatgaagtatttacacaatttcttgctgacaatcatcaccaagttcgcatgttggctgcagagtcaatcaatagattgttccaggacacgaagggagattcttccaggttactgaaagcacttcctttgaagcttcagcaaacagcttttgaaaatgcatacttgaaagctcaggaaggaatgagagaaatgtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctatagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 11929 - DNA, 8977 bp, Homo sapiens
catactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcaggggatttggatcctgctcctaatccacctcattttccatcgcatgtgattaaagcaacatttgcctatatcagcaattgtcataaaaccaagttaaaaagcattttagaaattctttccaaaagccctgattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggaaattaaccattttctctcagtaagtgtttatgatgcacttccattgacaagacttgaaggactaaaggatcttcgaagacaactggaactacataaagatcagatggtggacattatgagagcttctcaggataatccgcaagatgggattatggtgaaactagttgtcaatttgttgcagttatccaagatggcaataaaccacactggtgaaaaagaagttctagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattgtgtcaaagttcgatcagcagctgttacctgtttgaaaaacattttagccacaaagactggacatagtttctgggagatttataagatgacaacagatccaatgctggcctatctacagccttttagaacatcaagaaaaaagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcagagtcagagcactttttccgatgctgtttggataaaaaatcacaaagaacaatgcttgctgttgtggactacatgagaagacaaaagagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaagaagtcttgcatttgaagaaggaagccagagtacaactatttctagcttgagtgaaaaaagtaaagaagaaactggaataagtttacaggatcttctcttagaaatctacagaagtataggggagccagatagtttgtatggctgtggtggagggaagatgttacaacccattactagactacgaacatatgaacacgaagcaatgtggggcaaagccctagtaacatatgacctcgaaacagcaatcccctcatcaacacgccaggcaggaatcattcaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaatctctaagagacagagaattctctacattttatgaaagtctcaaatatgccagagtaaaagaagtggaagagatgtgtaagcgcagccttgagtctgtgtattcgctctatcccacacttagcaggttgcaggccattggagagctggaaagcattggggagcttttctcaagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcgaacaatcccagcctaaaacttacatacacagaatgtctgagggtttgtggcaactggttagcagaaacgtgcttagaaaatcctgcggtcatcatgcagacctatctagaaaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaagagagacggaatgaagattccaacatataaatttttgcctcttatgtaccaattggctgctagaatggggaccaagatgatgggaggcctaggatttcatgaagtcctcaataatctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggatcgaacagaggctgcaaatagaataatatgtactatcagaagtaggagacctcagatggtcagaagtgttgaggcactttgtgatgcttatattatattagcaaacttagatgccactcagtggaagactcagagaaaaggcataaatattccagcagaccagccaattactaaacttaagaatttagaagatgttgttgtccctactatggaaattaaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaagggccgtgatgacctgagacaagatgctgtcatgcaacaggtcttccagatgtgtaatacattactgcagagaaacacggaaactaggaagaggaaattaactatctgtacttataaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattgttggttacatacttggacttggtgatagacatgtacagaatatcttgataaatgagcagtcagcagaacttgtacatatagatctaggtgttgcttttgaacagggcaaaatccttcctactcctgagacagttccttttagactcaccagagatattgtggatggcatgggcattacgggtgttgaaggtgtcttcagaagatgctgtgagaaaaccatggaagtgatgagaaactctcaggaaactctgttaaccattgtagaggtccttctatatgatccactctttgactggaccatgaatcctttgaaagctttgtatttacagcagaggccggaagatgaaactgagcttcaccctactctgaatgcagatgaccaagaatgcaaacgaaatctcagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 11930 - DNA, 3830 bp, Homo sapiens
tccacctcttgtccctcggcctccgcgcctcccctcccccgactctctggcctcccattcattccgtccgctccctcccatttcctcttttccgctcgggccctctccccagagcctccccgcgcggaccccgctgcagtgtcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttctttttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcgttgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaatgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacatgatgagttatttggtgcactgatgccataatgtcttctatatgtaatatcttacatgtttgcatgagtgtcagggctttgtccagttatcttcatatgactgttctctgagaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaatt

SEQ ID NO: 11931 - DNA, 3972 bp, Homo sapiens
gctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 11932 - DNA, 4044 bp, Homo sapiens
ggcaatcattggtaacctcgctcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatgttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 11933 - DNA, 4084 bp, Homo sapiens
gtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccgggttggtatactgggttaactttgggaaatgcaagtgtttatctccaggatctagccaccggggtggtgtaagccgcaaagaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 11934 - DNA, 4016 bp, Homo sapiens
ggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 11935 - DNA, 3958 bp, Homo sapiens
agtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 11936 - DNA, 4247 bp, Homo sapiens
gttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggtttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaacctattgtaaatacaagttctatttaagtgtactaattaacatataatatatgttttaaatatagaatttttaatgtttttaaatatattttcaaagtacataaaaaaaaaaaaaaaaaa

SEQ ID NO: 11937 - DNA, 2203 bp, Homo sapiens
gtcgtctttctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaggacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaatttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagagaaac

SEQ ID NO: 11938 - DNA, 1783 bp, Homo sapiens
cctctcggagctggaaatgcagctattgagatcttcgaatgctgcggagctggaggcggaggcagctggggaggtccgagcgatgtgaccaggccgccatcgctcgtctcttcctctctcctgccgcctcctgtgtcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagcgccccgggccgcccccgcacgccgcccccatgcatcccttctacacccgggccgccaccatgataggcgagatcgccgccgccgtgtccttcatctccaagtttctccgcaccaaggggctgacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatccataaatttgatttttgctttgggtgggctcctcttggggatggattatggaatttaaaccatgtcacagctgtgaagatctggcacaagatagaatggtaaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcatttttaacc

SEQ ID NO: 11939 - DNA, 2816 bp, Homo sapiens
aggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttaaaaaaaaaaaaaaaaaaa

SEQ ID NO: 11940 - DNA, 3277 bp, Homo sapiens
cgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagtttttttttttttttgggacgaagttttgctcttgttgcccaggctgtatcgcaatggcgcggtctctgctcactgcagcatccgcctcccgggttcgggcggttctcctgcctcagcctcccgagtagctgggattacaggcgcccgccaccacacccagctaattttttgtatatttggtagagacggggtttcaccgtgttgaccaggctggtctcgagcttctggcctcaggtgatccacctgcctcagcctcccaaattgctgggattgcaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagctcagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcactttgggaggctgaggcaggcggattgcctgagatcgggagttcgagaccagcctggccaacatggtgaaaccttgtctctactaaaactacaaaaaaaattggccaggcgtggtggcgggcgcctgtaatcccagctactcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttgaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11941 - DNA, 3403 bp, Homo sapiens
tttactttgtctgctttgctaaggaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagccctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctg

SEQ ID NO: 11942 - DNA, 2730 bp, Homo sapiens
agaatgcctatgagacacaggaagaaggcagcagacaagaatcttccctgccgtcctttagtatgtgcagtactggacctgatggtagagtttattgtaacacacatgatgaaggagtttcctatggatctctatatacgctgcatccaggtagtacacaaactgctctgctaccagaagaagtgtcgggtacgcctgcattacacctggcgggagctctggtcagccttgataaatttgctgaagttccttatgtcaaatgagactgtacttttggccaaacacaacatttttacattagcccttatgattgtgaacctatttaatatgtttatcacatatggcgacacatttctgccaacccccagcagctatgatgaactttactatgagattatccgcatgcaccagagctttgacaacctctactccatggtcctgaggctttctaccaatgcaggccagtggaaggaagcagctagcaaggtgacccatgcattggttaatatcagagccatcatcaaccactttaaccccaaaattgagtcctacgctgctgtgaatcacatatcccaactgtcagaggagcaggtgctggaggtggtgagagccaactatgacacgctcacgctgaagctgcaggatggcctggaccagtatgagcgctactcagagcagcacaaggaagctgccttcttcaaagagctggttcgatccattagcaccaacgtccggagaaacctggtcttccacacactcagccaagaagtcctgctcaaggagttctccactatctcctgaggccacgcctacctgagcagcctctgactgcccttacccatgaggatcatgggctggagggggagcgaggggagagggggctgcccccgaggttggagagaaacacagataccaagttctcttggtgaagaccgcacttcaatggagcttgggcagcaggggcaggagggtcaagccagggataatcttatttggggaggaatgggtgggcacagtggggagaggcctccaggaatgtggggacttccagagtgggctccctaaacagcccctcacatttccaatcttgaggttacaagctgtagctactgactaattttcgggagctggtgaggcaagcctcagggtaatgccagcaccctgaaagtcagtggctctgctcggcttctgaaaacagatcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggagtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaacttcctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcgagatcctccctttttaaagcactttctaaagccctcaggatggcgggagcaaacagcactggtatattctaggagtaagtgcaggaattcagcagtgagagcatgtctgggaccacctggactgccatccatttaacctcaaatctctttgggatactcgccctccctgggaaccagagttctggctctaacattgagcagctatgcactagttccagagaagccactaacaggctgccatgtgtagatgtaggttcttaagagatcacaggctgggtcatctgatcactggatggatagctcagcctggggcatttagtgttttccctggtgataaatccccaaggcagctggatttggagctggtggcaagttgaaattattaaaaattgatttgtgtgggactgtc

SEQ ID NO: 11943 - DNA, 2175 bp, Homo sapiens
gcacactgaagagtacgtcttcgggtctacccctaatcacataatggctgtgtttaatcagaagtctgtctcggacatgattaaagagtttcgaaaaaattggcgtgctctttgtaactctgagagaactactctatgtggtgcagactccatgctcttggcattgcagctttctatggcagagaacaacaaacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaagacacaatccatcatcatggaacgtctattcttacactttttaggtctcccacacaggtgaataatttgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgcatctataaaccattcaccaaagacatgcttaatttttaagagatcaaggtgtaaattatgatgatttattattttggtctacagtgtatgtaaggttagtatgttaagcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgaaaaaaaaaaaaaaaaa

SEQ ID NO: 11944 - DNA, 2891 bp, Homo sapiens
aaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcccgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattctatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagagtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctatgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgcttttttttttttttaaaggaaagctgctctttgctcagtatagtgttttgaaagtgaacatagtaacaaatactttaaaaataaagatacacaatttatatttg

SEQ ID NO: 11945 - DNA, 2157 bp, Homo sapiens
gatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttggggatgaaagtaagcttcaagataaaatcttcatcacccagcaaattgcaatatcagactcttctggtgaagtggtgctacccactattccaaaagaacctcaggagtctgacacaggaaccttctgagaagcactgattatgacctcacagatgctgctggcagtcccttccttgcagaatccttgctcctgaatatctttaagaaaatttcttaaaggaaaagacaaaaaatttaactcaaaagttacctgtttgccatagaaattggtgtctcccctgaaggaggatcgagagccggtgaatgagaacattggcaaaggcactggaatggggacattcactcccacctaaaacagaacaaatccgtgtcatatcctaaggacaaaggaactctccatttagaaacacaaaggcatcagagaccagttttaaatacccaccttctaccctatcctctaccccatgaactttcattcctgaggaagaaatggggcaatgtgggaggtcatgggggcaatcttaaaccaatgactcaccattatttactgtttcctcttaggaaatagtaaatggatataagaatctcttaaaaattctgttcacgaacctgtccaacatccaccaagtgggcatatttccgagcagtggctccattggtggtgaagatggcagttccatttccatatgggttgttatttacaatctggatggcttcatccaatgtttctgtctccagaaccacaagaactggaccaaaaatctcctctttgtaacaggtcatatttggctgccaggagtgatgcatccagaaaagaagtcagctttttggattctgagtattttatgcttatttggtactttcacttactacacatcatttacgtggacaactttcatattactaatctcttttcatttcaaatcacctatttaaaaaaaaagtcctctctcaagtgtattccgtcttccaagttaccaatcatataaacaacttggaattcctatcaacaataaccacacttcctttaagggactgtatctttagttcatgacccatcatcagctgcctttttaatacctgaacgactagtttcatccaattgttatcaaaaagttacatgaaaatttattttttataaatccaatctatagtaaatataccaggataatttttctctttacagaaaccccatgctgttttctgtaacataaataatccattcttattcactcctttgcctcccaaatatgtctgtatgtttatattttgatatcaggtcgcagacactcaaaacatccttcaccatgcaattaatgtttgttgctgataaacggatttttctgtatggttctgtggcaagagatttcataatttctactgcacttacattcaacacttgatgattcactattatagtaaggatatatgaatttcaaaaaatgcctcataacctcaatttttaagtcatgttagctgagagactttcaaagttttgataaataaaaattgccaagtcaaaaaaaaaaaaaaaaaaaa

SEQ ID NO: 11946 - DNA, 3290 bp, Homo sapiens
ctctagagaacgctctgcactatggctggtcccgtgagcttgcgagaccttctaatgggagcgtcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaataaaaaaaaaaaaaaaaaaaaaaaaaaaaaaaaaaaaaaaaaaaaaaaaaaaaaaaag

SEQ ID NO: 11947 - DNA, 861 bp, Homo sapiens
ccacggcgtccagggcgaccagccgcgggccgcagggcatggaccttcaggccgccggggcccaggcgcagggggccgcggagccgtctcggggcccgccgctgcctagcgcgcggggggcgccccccagcccggaggctggctttgctacagctgaccactccggtcaggagagagagactgagaaggctatggatcgactagcccgtggaacacagagcattcctaatgacagtcctgcccggggtgagggcacccattctgaagaggaaggctttgccatggatgaggaggactctgatggagaactgaatacctgggagctgtcagaagggacaaactgtccacccaaggaacagcctggcgatctttttaatgaggactgggactcggagttgaaagcagatcaagggaatccatatgatgctgacgacatccaggagagcatttctcaagagcttaaaccttgggtgtgctgtgccccacaaggagacatgatctatgaccccagctggcaccatccgcctccactgataccctattattccaagatggtctttgaaacaggacagtttgacgatgctgaagattgagtgtggagctttctgccttgtaggtgggcgggcctccacgtcaagatctcttttcctgtcttggaggtgaaaagtcatatctgagaaaatgtttgcagtgacccctagtctggggtacacagaccagtgttccttattgacagtgttcaataaggccccgtcattctcgccagtctgttgttgttcttaatgggctcctccttgaaatgtgtgtgtgtttgtgtcaagaggagttgtgttctttgtaaataaaggttaaaaaaaaaaa

SEQ ID NO: 11948 - DNA, 2821 bp, Homo sapiens
gctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggacttagcaggggcggaggagttcggcggcggagaggaggggacagggctgacagggataaaggagataggggatggagaggaaggaagtggacaaaggccagaggaaataccgatggacctaacggtagtgaagcaggaaattatagactggccaggtacagaaggcaggttggctggccagtgggtagaacaggaggtggaggataggcctgaggtgaaggatgagaacgcaggcgtattggaggtgaagcaggagacggatagtagtttagtggtaaaagaagcgaaggtgggtgaaccagaggtaaaggaagagaaggtaaagggagaggtaatggactggtcagaagtgaaggaagagaaggataacttggagataaaacaggaggagaagtttgttggtcaatgcataaaagaggaattgatgcatggagagtgtgtaaaagaagagaaggatttcctgaagaaagaaatcgtggatgatacaaaggtgaaagaagagcctccgataaatcacccggtgggctgcaagcggaaactggccatgtcaaggtgtgagacttgtggtacagaagaagcaaagtacagatgtccacgttgtatgcgatattcctgcagtttgccttgtgtaaagaaacacaaagcagaactgacatgtaatggagttcgagataaaactgcatacatttcaatacaacagtttactgaaatgaatctcctaagtgattatcgatttttggaagatgtggcaagaacagcggaccatatttctagagatgcttttttgaagagaccaataagcaataaatatatgtactttatgaaaaatcgtgcccggaggcaaggtattaacttaaaacttctacccaatggattcaccaagaggaaggagaattcaaccttttttgataagaaaaaacaacagttttgttggcatgtgaagctccagtttcctcaaagtcaagctgagtacatagaaaaaagagtaccagatgataaaactattaatgaaatcctaaaaccttacattgatcctgaaaagtctgatcctgtaattcgtcaaaggttgaaagcctacattcgctctcagactggggttcagattttaatgaagattgaatatatgcagcaaaatttagtaagatattatgaactagatccttataaaagtctcctagacaatttgaggaacaaagtgatcattgagtatccaacattacatgtggtattgaaaggatccaataatgacatgaaagttcttcaccaagtgaagagtgaatctaccaagaacgttggcaatgaaaattgagcattttttctggaagaagaaagtgaaaacttccagacaactgcagcagactctgcattgatgggctgttggctgattggggtattgtcaatgggtgattggaattttttctttgtatgaaaaataagcttaactcttttaaaaaatgtattttataacctcttgaattaattgacttgtaagacccatttattcatattaagaactctcctttgcacttgatcagcatagtacttattaggccctggctttttaatatgcttaattgcttaattccataaactgaaaactttttttttcttttttctttctttttttgagatggggtcttggagtgcaagtggtatgagcatagcttcctcaaattcctgggctcgaatggtcctctcactgcagcctcccaacaggctggtaccaccacactcagctaagttttttgttgttttttttttttggtagagacagggttgcgctctttcgcccaggctggtctcaaatttgtggcctcaagcaatccttccacctcagactccaaagcattgggattacaggcatcagccaccacacctggccttgaacattttttatttgttaatttcatgcgtgacgaaacccaaggatcacccatgtcaaccacaaagttggcattccctttagtagaacctcactaaacggaaaggctgtacaacgcaccgtctagccacaggagaactaatcttctatcagttgccctttcttctttggagtttttatgtaacttacccttgtgagacaagttttctacttgagaaactcctagtacaatgtcttatactagaagcctggataaatactattaactactgtttcttatattcacttcagaaaatcagtggctccacattgtttgagccattagtgataacaaatttggatctacttactcaagtcttatgaattctgtgcctttcatcacattcctagcccactctcatcattactgcagaagggtgttgtgatgaccagttttatactgtgttttgatatgtctagcaataacttaaagaaaaaaaaacctgggaaatcttcaacatgttattggaacatatatgtatgtattaatgtatatacatggcttaacttatacgttatggcagctctgtatacagtttgatctcatgtactgaaaaaaaattcttaattttattggagtttataccactgtgaaactgcaatatgactgtaagagagtaaaaagattgttacatctaaaaaaaaaaaaaaaaaaaaaaaaa

SEQ ID NO: 11949 - DNA, 2820 bp, Homo sapiens
ctggcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccctgccttgcccctggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacgaggacatgcaggagaactgtcgggaccaggaagactcattccaaaaaggagcccaggccgggcacagtcgtcaagcctgtaatcccaacactttgggagaccgaggtcgggggatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcgtttcttttgatggggcctcctgtacgtaggctgcagacgtgaaagccccaggggtccatttgtatcaattttcatcttgttttgtttgttttgatttcatttacgtttttctttttcccatgagtgaggatagctaataaatcatctttgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 11950 - DNA, 1499 bp, Homo sapiens
ccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacagaacatatgctgtcaggaggataagagatgccttcagagaaaataaaaatgtaaaggatcctgtagaaattcaaaccctagtgaataaagccaagagagaccttggagtaattcgtcgacaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagccccagcctgacccaagcccagggcgactcccataccctgaagcctggggcatgctgggcagcaccggtgcccaaatctggctggtggacagaagcacctggagagttggagagctttttaaaaagacatctctcagcacttccctctctgcagattctgactcagtaagtgaggggtgaggcacagtcatttttctctattctgaagctctcccactgttttcaatgtttaaccaactggggacccctgctctttaagtatattacaggtaataaagatattgtttgtatgcttttaaaaaaaaaaaaaaaaaa

SEQ ID NO: 11951 - DNA, 2106 bp, Homo sapiens
agaagggcgtcgggcggccgtcgggacggaagccgggaggcgctgccgaccgcgcctgcgacagcgtcagccctgcgcggagcgccggcccgatggcggcggcggcggcgatggccgagcaggagagcgcccggaacggcggccgcaaccgcggcggcgtccagcgtgtggagggcaagctgcgcgccagcgtcgagaagggcgactactacgaggcgcaccagatgtaccggaccctgttcttcaggtacatgtcccagagcaagcacacggaggcccgggagctcatgtactcgggagccctgctcttcttcagccatggccagcaaaacagtgcagcagacttgtccatgctggtcctggagtccctggagaaggcggaagtggaggtggctgacgagctgctggaaaatctggctaaagtgttcagcctgatggaccccaactctcctgagcgcgtgacctttgtgtccagagccctgaagtggtccagtgggggctccgggaagctgggccacccccggctgcaccagctgctggccctcaccctgtggaaagaacaaaactattgtgagtcgaggtatcattttctgcactcagcggacggggagggctgtgccaacatgctggtggagtattccacgtcccgcggcttccgcagcgaggtggacatgttcgtggcccaggccgtgctacagtttctctgtttaaaaaacaaaagtagcgcatcggtggtcttcacgacgtacacccagaagcacccgtccatcgaggacgggcctccgtttgtggagccgctgcttaacttcatctggttcctgctgctggctgtggacggtgggaagctgacggtgttcactgtgctgtgtgagcagtaccagccatccctccggcgggaccccatgtacaacgagtacctcgaccgcataggacagctgttcttcggcgtcccgcccaagcagacgtcttcctacgggggcctgctcgggaaccttctgaccagcctcatgggctcctcagagcaggaggatggggaggagagccccagcgacggcagccccatcgagctggactgaactggccaggccacgtggagacaccacggtcgacgacggctggagggacgtttcagaggcgagtcctgggtggctcctcgccttgggggctcctggccctgaggctggcggtggccgcatgccggcgcgtgtctgtttctgtgcggcggctcagggtggcgcggctgctgctcactgtgctgctgggacccaagagtggggcgtcgcccctgctggccgccgcgtcccccgagattgacccacaataaagcacaggccttaccgcggcgtcaccctctcccactcctttgttctgggtcctttcgggagggctgatgggcagcacaggaggcccgtcctcggggggctgcgcacatcacgctccttgccgggcgtccggcacagctgcggtcaccaaagcaggtgctggccctcggacctgagagcccagccagggcccatgtggtctgcaaatgggagcggctgtttttgaacacggggtcattctgcagtcaggacgaaccggtccccgtcgcagacggagtgcacgtgccctgcgccacatcctcacgctcggtggagggacgcgtgcggcgggacggtgcctacgggtacttgcagctgtgtcccatgtggcatcccagagctgcgccctgctggtctctgtgagcgccacgctgctgtgctggaaatgccgctttaaaaagggataccgtgggactctgcccgtctctttcataacgcaatatttatttgtattgggtgatgattgattctttcgacctaacattttgggttttaaccaaataaccggtccaggagtgagcagctccgttctgtcagatgctactccaaatgttaccagaacgatgacaaaaggggagacgctctattttttcacagttaaatgacagttgtagattgatacgcagttgtgcatgggaaggggaaacgcacagctttatttactgtaaagtggaatttcaggaaggcttgtgtgaaccgttgcgcataaataaaccctttctaccggaaaaaaaaaaaaaaaaaa

SEQ ID NO: 11952 - DNA, 1453 bp, Homo sapiens
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 11953 - DNA, 1413 bp, Homo sapiens
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgggcatgaagctgacctcagaggagtttaacgcgatcttcacattttacgacaaggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 11954 - DNA, 1359 bp, Homo sapiens
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 11955 - DNA, 2625 bp, Homo sapiens
atagggtccacagccttgtgttcttcaaatactgtaaagcagccctctccagattccttgagggtcactttatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttggatataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagggcggaggcgcggcctggagggactagttggcgcgcggctgcccggcgtggtgacgtcagggcggaagcgcacgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaa

SEQ ID NO: 11956 - DNA, 3260 bp, Homo sapiens
ccatcccatagtgagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcacgttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagtgacgccaaccctcccgtctcccactacacctggtttgactggaataaccaaagcctcccccaccacagccagaagctgagattggagccggtgaaggtccagcactcgggtgcctactggtgccaggggaccaacagtgtgggcaagggccgttcgcctctcagcacccttactgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctccccggacctgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgtgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatcatctaaatacctgccctgacatgcacacctcccctgccccaccagcccactggccatctccacccggagctgctgtgtcctctggatctgctcgtcattttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 11957 - DNA, 3098 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcactctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacagagtgcttctcccgcagccctactggaacacagcagagtctgtgccatgaagcagttacagaaacagaattgatgtgctgctaaaaaaaaaaaaaaaaatggggcccgggggggcgtccgccggccctgcgggccgccggtgaaataccactactctgatcgttttttcactgacccggtgaggcgggggggcgagccccgaggggctctcgcttctggcgcg

SEQ ID NO: 11958 - DNA, 4624 bp, Homo sapiens
cacggaacagccctcctggggtccccacgagccgcgtcctgctgtgccccggcgcctacgcagcagcggccgcggccgcggtgggcacgcacggttaccccgggcagctccggccgccagctgcagccccgtcgcctcggccgcgccagccggctgcgggcacctgggggcgggctgggggcgccggccgcggcaggaggcgctgtagcgagggctgcggcgccggtcctgcggcggccgcgggaggcagcggggcaggcgctgtgggccgggctcctcctccggctcctgcgcgaccgcctcccgccgggctctgccggcgcccgccgtccccgcagcgccgctctgcgcccgccgccccgagcgcccgcgcggggctggcgggagcctcggcgggcgcgcgggcgcgcggggccatggtcgtggccccctgacgggccgcggccgcctccatgaagcggaaaagcgagcggcggtcgagctgggccgccgcgcccccctgctcgcggcgctgctcgtcgacctcgccgggtgtgaagaagatccgcagctccacgcagcaagacccgcgccgccgggacccccaggacgacgtgtacctggacatcaccgatcgcctttgttttgccattctctacagcagaccaaagagtgcatcaaatgtacattatttcagcatagataatgaacttgaatatgagaacttctacgcagattttggaccactcaatctggcaatggtttacagatattgttgcaagatcaataagaaattaaagtccattacaatgttaaggaagaaaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttttcatgcagtaaagaaggcaatgcagtatggcttccttaatttcaactcatttaaccttgatgaatatgaacactatgaaaaagcagaaaatggagatttaaattggataataccagaccgatttattgccttctgtggacctcattcaagagccagacttgaaagtggttaccaccaacattctcctgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaagaattcctagatatctgtgaaaatgctgagggtgccattgcagtacattgcaaagctggccttggtcgcacgggcactctgatagcctgctacatcatgaagcattacaggatgacagcagccgagaccattgcgtgggtcaggatctgcagacctggctcggtgattgggcctcagcagcagtttttggtgatgaagcaaaccaacctctggctggaaggggactattttcgtcagaagttaaaggggcaggagaatggacaacacagagcagccttctccaaacttctctctggcgttgatgacatttccataaatggggtcgagaatcaagatcagcaagaacccgaaccgtacagtgatgatgacgaaatcaatggagtgacacaaggtgatagacttcgggccttgaaaagcagaagacaatccaaaacaaacgctattcctctcacagtaattcttcaatccagtgttcagagctgtaaaacatctgaacctaacatttctggcagtgcaggcattactaaaagaaccaccagatctgcttcaaggaaaagcagtgttaaaagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgccaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccgg

SEQ ID NO: 11959 - DNA, 2944 bp, Homo sapiens
agatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagcttttgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaa

SEQ ID NO: 11960 - DNA, 1474 bp, Homo sapiens
agccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtcttttttttttttttaaaaaaaaaaaaaaaaaaaaaaaaaaaaaaaa

SEQ ID NO: 11961 - DNA, 5705 bp, Homo sapiens
ttgcgcgctgcagggcaacaccccggcgtccctggaagctgggggagcgggagaaataactttatttggactgagagctggagaatgagaataggacctgagagtatattgggctaaggaggagaggtgtttgagcccagatgagtcatggctggacgacccctccgcataggagatcagctggttctggaagaagattatgatgagacctacattcctagtgagcaagaaattcttgaatttgcccgggagattggtattgatcccatcaaggaaccagaactgatgtggctggcgcgagagggcatcgtggccccactgcctggagagtggaaaccatgccaggacatcacaggtgacatttactatttcaacttcgccaacgggcagtctatgtgggaccatccatgtgacgaacactatcggagcttggtgatccaagagcgggcaaagctgtcaacttctggggccattaagaagaagaaaaaaaaaaaggaaaagaaagacaagaaggacagagacccccccaaaagttcgctggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctgccttcacagggtctcaagacctctgcttatacaaagggtctcttgggctccatatatgaggacaagactgctctcagcctcttgggtttaggagaagaaaccaatgaggaggatgaggaggaaagtgacaaccagagtgtccacagctcaagtgagcctcttaggaacctacacctggacattggggcactggggggtgactttgagtatgaggagtctctgagaacaagccagccagaggagaagaaggatgtttctctggattcagatgctgccggtccccctactccctgcaagccctccagcccaggtgcagacagcagtctgagcagtgctgttggcaaagggcgacagggaagtggagcaagacctggtcttccagaaaaagaggaaaatgagaagagtgaacctaagatttgcaggaatctggtgacccccaaggcagaccctacaggcagtgagcctgccaaagcctctgaaaaggaagcaccagaggacacagtagatgcaggagaggagggttccaggagggaagaggcagccaaggagccaaagaagaaggcttctgctctggaagagggcagttcagacgccagccaagaactggaaattagtgaacacatgaaggaaccacagctctcagactccatagcttctgaccccaagtccttccatggcctggacttcggttttcgcagccggatctcggagcacctgctggatgttgatgtgctttccccagtcctgggtggagcttgtcggcaggcccagcaaccactgggaatagaagacaaggatgacagccagtccagccaagatgagctgcagagcaagcagtccaaaggcctggaggagaggttatctcctccacttccacacgaggagcgggcccagagtccccctcgcagcctggccactgaagaagagcccccccagggccccgaggggcagcccgagtggaaggaggcagaggagcttggggaggactctgcagccagcctcagcctgcagctgtccctccagagggagcaggccccaagcccacctgctgcctgtgagaagggcaaggagcagcattcccaggccgaggagctgggccctgggcaggaagaggcagaggatcctgaggagaaggtggcggtcagccccaccccgccagtctctccagaggtgcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccggcttcaccagcagaaagagcaatctctcagttccttgagggagcggctgcagaaagccattgaggaggaggaggcccggatgagagaggaggaaagccagaggctatcctggctccgagctcaggtccagtccagcacacaagcagatgaggaccaaatcagggctgagcaagaggcttccctgcagaaactgagagaagagttggagtctcaacagaaggctgagagggccagcttggaacagaaaaataggcaaatgctggagcagctcaaggaagagatagaggcttcggagaagagcgagcaggctgccctgaatgctgcaaaggagaaggctctgcagcagctgagggagcagctggaaggggagaggaaagaagctgtggcaacgctggagaaggagcacagtgctgagctggagcggctctgctcctcattggaggccaagcaccgggaggtggtctccagcctccagaagaagatacaggaagctcagcagaaagaggaggcccagctgcagaagtgccttgggcaagtggagcacagagttcaccagaagtcttatcacgtggctgggtatgagcacgagctcagcagtctcctgcgagagaagcgccaggaagtggaaggggagcatgagaggaggttggacaagatgaaggaggagcaccagcaagtgatggctaaggccagagagcagtatgaagctgaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggaaaggaagctccaggatttagagttggaccttgaaaccagagctaaagatgtcaaggccagattggctctgctggaggtccaggaggagaccgcccggagggagaagcagcagctgcttgatgtgcagaggcaggttgctctgaagagtgaggaagccacagccacccatcagcagctggaggaggcacagaaggagcacacccacctgttgcagtcaaaccagcagctccgagaaattcttgatgagctgcaggcccgcaagctgaagctggagtcccaagtggatctgctgcaggctcagagccagcaactgcagaaacacttcagcagcctggaggctgaagctcaaaagaagcagcacctgttgagagaagtgacagttgaggaaaataatgcttccccacattttgagccagatctccatattgaggacctgaggaaatcccttggaacaaaccagaccaaagaggtgtcttcttctctctcccagagcaaggaggacttatacttggacagcctgtcctcccacaatgtctggcacctcctctctgctgagggggtagccctccgtagtgccaaggagttccttgtgcggcagacacgctccatgcggaggcggcagacagctctgaaagctgcccagcagcattggcgccatgagctggccagtgcgcaggaggtggccaaagacccaccaggcatcaaggccctggaagatatgcgcaagaacctggagaaggagaccaggcacctggatgagatgaagtcggccatgcggaaaggccacaacctgctgaagaagaaagaggagaagctgaatcagttggagtcctctctttgggaagaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggatcgactcaaccccgagtctcacctcccgcaagatccacgggcttagccactccctccggcagatcagcagccagctgagcagtgtcctcagcatcctggacagcctcaaccctcagtcgccgccgccgctcctcgcctccatgccagcccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatctggcatcccgctgctcagcaatagccccaccccgctggagagcaggctgggttacatgtctgccagtgagcagctccggctcctacagcactcccattcgcaagtccctgaggcgggcagcaccacctttcagggcataattgaggccaaccggaggtggctggaacgtgtcaagaatgaccccaggttacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccctccttccccctttgacttgcaggagccaccagggaccagggggttgagtggaacagtaaagccacacattctgtgactatataacctatctcaggctaaaatgtgtggacttgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagacccttttttttttgtctttcttctcttaatttttaaatgcctcttttcttgagcattccatctctctttttgaccctctcaggactgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacaacttctccaggaggccaaaaaaagactgggttggcttctggtcctcatgacggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaagcaaaaaaaaaaaaaaaaaaaaaaaaaaaaaaaaaaaaaaaaaaaaaaaaaaaaaaaagaaaaaaaaaaaaaaaaaa

SEQ ID NO: 11962 - DNA, 3123 bp, Homo sapiens
ccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgatttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttca

SEQ ID NO: 11963 - DNA, 2448 bp, Homo sapiens
ctcctccccctcaccgtcccaattgtattccctggaagagcagccggaaaagcctccgcctgctcataccaggataggcaagaagctggtttctcctcgcagccggctccctgaggcccaggaaccaccgcggcggccggcaccacctggacccagctccaggcgggcgcggcttcagcaccacggacagcgccccacccgcggccctccccccggcggcgcgctccagccggtgtaggcgaggcagcgagctatgcccgcggcatggcccggcgctgcggccccgtggcgctgctccttggcttcggcctcctccggctgtgctcaggggtgtggggtacggatacagaggagcggctggtggagcatctcctggatccttcccgctacaacaagcttatccgcccagccaccaatggctctgagctggtgacagtacagcttatggtgtcactggcccagctcatcagtgtgcatgagcgggagcagatcatgaccaccaatgtctggctgacccaggagtgggaagattatcgcctcacctggaagcctgaagagtttgacaacatgaagaaagttcggctcccttccaaacacatctggctcccagatgtggtcctgtacaacaatgctgacggcatgtacgaggtgtccttctattccaatgccgtggtctcctatgatggcagcatcttctggctgccgcctgccatctacaagagcgcatgcaagattgaagtaaagcacttcccatttgaccagcagaactgcaccatgaagttccgttcgtggacctacgaccgcacagagatcgacttggtgctgaagagtgaggtggccagcctggacgacttcacacctagtggtgagtgggacatcgtggcgctgccgggccggcgcaacgagaaccccgacgactctacgtacgtggacatcacgtatgacttcatcattcgccgcaagccgctcttctacaccatcaacctcatcatcccctgtgtgctcatcacctcgctagccatccttgtcttctacctgccatccgactgtggcgagaagatgacgttgtgcatctcagtgctgctggcgctcacggtcttcctgctgctcatctccaagatcgtgcctcccacctccctcgacgtgccgctcgtcggcaagtacctcatgttcaccatggtgcttgtcaccttctccatcgtcaccagcgtgtgcgtgctcaacgtgcaccaccgctcgcccaccacgcacaccatggcgccctgggtgaaggtcgtcttcctggagaagctgcccgcgctgctcttcatgcagcagccacgccatcattgcgcccgtcagcgcctgcgcctgcggcgacgccagcgtgagcgcgagggcgctggagccctcttcttccgcgaagccccaggggccgactcctgcacgtgcttcgtcaaccgcgcgtcggtgcaggggttggccggggccttcggggctgagcctgcaccagtggcgggccccgggcgctcaggggagccgtgtggctgtggcctccgggaggcggtggacggcgtgcgcttcatcgcagaccacatgcggagcgaggacgatgaccagagcgtgagtgaggactggaagtacgtcgccatggtgatcgaccgcctcttcctctggatctttgtctttgtctgtgtctttggcaccatcggcatgttcctgcagcctctcttccagaactacaccaccaccaccttcctccactcagaccactcagcccccagctccaagtgaggcccttcctcatctccatgctctttcaccctgccaccctctgctgcacagtagtgttgggtggaggatggacgagtgagctaccaggaagaggggcgctgcccccacagatccatccttttgcttcatctggagtccctcctcccccacgcctccatccacacacagcagctccaacctggaggctggaccaactgctttgttttggctgctctccatctcttgtaccagcccaggcaatagtgttgaggaggggagcaaggctgctaagtggaagacagagatggcagagccatccaccctgaggagtgacgggcaaggggccaggaaggggacaggattgtctgctgcctccaagtcatgggagaagaggggtataggacaaggggtggaagggcaggagctcacaccgcaccgggctggcctgacacaatggtagctctgaagggaggggaagagagaggcctgggtgtgacctgacacctgccgctgcttgagtggacagcagctggactgggtgggccccacagtggtcagcgattcctgccaagtagggtttagccgggccccatggtcacagacccctgggggaggcttccagctcagtcccacagccccttgcttctaagggatccagagacctgctccagatcctctttccccactgaagaattc

SEQ ID NO: 11964 - DNA, 1431 bp, Homo sapiens
gctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctg

SEQ ID NO: 11965 - DNA, 1289 bp, Homo sapiens
caccgccattgccgccatcgtcgtggggcttctggggcagctagggctgcccgccgcgctgcctgcgccggaccggggcgggtccagtcccgggcgggccgtcgcgggagagaaataacatctgctttgctgccgagccagaggagaccccagacccctcccgcagccagagggctggagcctgctcagaggtgctttgaagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaa

SEQ ID NO: 11966 - DNA, 1067 bp, Homo sapiens
gctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtcacccttgtggttggagcgtcccaggacatcatcccccagctgaagaagaagtatgatgtggacacactggacatggtcttcctcgaccactggaaggaccggtacctgccggacacgcttctcttggaggaatgtggcctgctgcggaaggggacagtgctactggctgacaacgtgatctgcccaggtgcgccagacttcctagcacacgtgcgcgggagcagctgctttgagtgcacacactaccaatcgttcctggaatacagggaggtggtggacggcctggagaaggccatctacaagggcccaggcagcgaagcagggccctgactgcccccccggcccccctctcgggctctctcacccagcctggtactgaaggtgccagacgtgctcctgctgaccttctgcggctccgggctgtgtcctaaatgcaaagcacacctcggccgaggcctgcgccctgacatgctaacctctctgaactgcaacactggattgttcttttttaagactcaatcatgacttctttactaacactggctagctatattatcttatatactaatatcatgttttaaaaatataaaatagaaattaa

SEQ ID NO: 11967 - DNA, 5064 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaattggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaagtttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaaaaaaaaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgaaaaaaaaaaaaaaaaagcg

SEQ ID NO: 11968 - DNA, 2717 bp, Homo sapiens
ttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattgatcaaaaaaaaaaaaaaaaaa

SEQ ID NO: 11969 - DNA, 2231 bp, Homo sapiens
cctttgcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaaaaaaaaaaaaaaaaaaaaaaaaaaaaaaa

SEQ ID NO: 11970 - DNA, 3412 bp, Homo sapiens
agttttgctccgaaagacttaccgaggagggagcttgcggtgcgttctgggaaagttgctgggccagctcctttgtttccagtctgagcgttgcgttcggtttcccgagggtcttctgaggcaccgcggctgcgggcttctgagttcccggctctccgcagggaagcctcctcttcgtacctcgttttttggctcgtggggggtcctcccaccgctggccgacgcagccagcatgtccggggtgcgcgcagtgcggatcagcatcgaatcggcctgcgagaagcaggtccatgaggtgggcctggatggcaccgagacgtacctgcccccgctgtccatgtcgcagaatctggcgcgtctggcccagcggatagacttcagccagggttcgggctccgaggaggaggaggcggcggggaccgagggcgacgcgcaggagtggccgggcgccgggtccagcgcagaccaggacgacgaggaaggagtggtaaaatttcagccttccctttggccttgggactcagtgaggaacaatttgagaagtgccctgacagagatgtgtgttctctatgatgttctcagtattgttagggataaaaaatttatgactcttgatcctgtctctcaggatgcacttcctccaaaacagaatcctcagacgttgcaattgatatctaaaaagaagtcacttgctggagcagcacaaatcttattgaagggggcagaaagactgactaaatcagttaccgaaaaccaagaaaacaagctacaaagagacttcaattctgagcttttgcgattacggcaacactggaaacttcgaaaagttggagataaaattctcggagatctgagctacagaagtgcaggatctctctttcctcatcatggtacatttgaagtaataaagaatacagatctcgatctggataaaaagatacctgaagattactgtcctcttgatgtccaaattcctagtgatttagaggggtctgcatatatcaaggtttcaatacaaaaacaggctccagatataggtgacctcggcacagttaacctcttcaaacgacctttgcccaaatccaaaccaggttccccacattggcagacaaaattagaagcggcacagaatgttctcttatgtaaagaaatttttgcacagctctctcgggaagctgttcaaattaaatcacaagtccctcacattgtggtgaaaaaccagattatctctcagccctttccgagcttgcagttatctatttctttgtgccattcctcaaatgataagaaatcccaaaaatttgctactgagaagcaatgtccggaggaccacctttatgtcctagagcataatttgcatctactgattagagagtttcataaacagaccttgagttccatcatgatgcctcatccagcaagtgcaccttttggccacaagagaatgagactttcgggtcctcaagcttttgataaaaatgaaattaattcattacagtccagtgaagggcttctggaaaaaataattaaacaagcaaagcatatttttctaaggagtagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtccattcaactgcaattgaatattggagttgagcagattcgagttgtacatagagatggaagagtaattacactgtcttatcaggagcaggagctacaggattttcttctgtctcagatgtcacagcaccaggtacatgcagttcagcaactcgccaaggttatgggctggcaagtactgagcttcagtaatcatgtgggacttggacctatagagagcattggtaatgcatctgccatcacggtggcctccccaagtggtgactatgctatttcagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtagctgggaccacaggcatgcacaaccacgcctggctaatttttgtattttttataaagacagggtttttccatgttgcccaggctggtttcgaactcggctcaagtgatctacctgcctctgcctcccaaagtgctaggattacaggcgtgagccaccatgcccagcctactctaaattattgataacctcttcctccagttgtctcctttaagctttcctgggtctaacctacataggtaatttaagaacatcctcagaaaggacagctgaaggcaataggaggcagattatctctttagggcgtcctcaagtttttttggtctgttctcccacttgattgacctcaccagttgagacacctagtgtatggctcatgcccagccttccacctgggattctccagcctccacccagcagccctggattgctttctccaattaaggcctttccatcagctctctgctttttcaaagcgaaaaaactaatggattagtgggttatcttttccaaggaacaggtttgcacttcttggaaaaagtgcctaaagtgtgcccattaatatgaggatagatttaggctcataagccttttggtaacactgaaagtagtatcatataggcaagctctccttataagtaaggctttcaatttttaaaacagacatcctgctttaacaatttgtaagatgactgtgcagtaataaaagtcctttgtatttc

SEQ ID NO: 11971 - DNA, 1897 bp, Homo sapiens
actttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcgggaagaagaaatgactgtggtggaggaagcggatgatgacaaaaaaaggctgctgcagattattgacagagatggggaagaggaagaggaagaggaggagccattggatgaaagctcagtgaagaaaatgatcctcacatttgaaaagagatcatataaaaaccaagaattgcggattaagtttccagacaatccagagaagttcatggaatccgagctggacctaaatgacatcattcaggagatgcacgtggtggccaccatgccagacctgtaccaccttctggtggagctgaatgctgtacagtcgcttctcggcttgctcggacacgataatacagatgtgtccatagctgtggtcgatttgcttcaggaattaacagatatagacaccctccatgagagtgaagagggagcagaagtgctcatcgatgctctggtggatgggcaggtggtagcactgctggtacagaatctggagcgcctggatgagtctgtgaaagaggaggcagatggcgtccacaacactctggctattgtggaaaacatggctgagttccggcctgagatgtgtacagagggtgcccagcagggtcttctacagtggctgttgaagaggctgaaggcaaagatgccttttgatgccaacaaactgtattgcagtgaagtgctggccatattgctccaggacaatgatgaaaacagggaattgcttggggagctggatggaatcgatgtgcttcttcagcagttatccgtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaagagcatgtctgttcgatcctggcttccctcctgcggaacctgagagggcagcagcggacccggcttctgaataaattcactgaaaatgacagtgagaaggttgacagactaatggagttgcattttaaatatctgggtgcaatgcaggtggcggacaagaagattgaaggggaaaaacacgacatggtccggcgaggagagatcatcgacaatgacaccgaggaggagttctacctccggcgcctggatgcggggctctttgttctccagcacatctgctacatcatggccgagatctgcaatgccaatgtcccccagattcgccagagggttcaccagatcctaaacatgcgaggaagctccatcaaaattgtcaggcatatcatcaaggagtatgcagagaacatcggggacggccggagcccggagttccgggagaacgagcaaaagcgcatcctgggcttgctggagaacttctagaggcaccttggccctgcgcatcatggactctctcagcttccctcccaggatcagtttctacacaactctgtgtggcttttggacaaattaaagctagttttggtaaaaaaaaaa

SEQ ID NO: 11972 - DNA, 4612 bp, Homo sapiens
tgccatcttggctcaccgcaacctctgccttccaggttcaagcaattctcctgccttagcctcctgagtagctgggattacaggcatgcgccaccacgcccaggaggcgatcccgcgccctgggtgcggtgaggccgctgggacagcggaggtgcctcccgacgcgaagcagcgagctgaggcggcggccagcggggaagatgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaattacgtggctggaggccaggaagccttcaagaaactcaattacttggacataggagaaatcaagaaaagaccaatggaagttgttaatacagaggtaaaaccagtaatccatagcaggatcaacgtgtcagctcgctttagaaaaccgcttcaggagccgtgcactatcttcttgattgcaaatggagacctcataaacccagcttctcgcctccttatccccagaaaaaccttgaatcagtgggatcatgtactacaaatggtcacagaaaaaatcactctgaggagcggggctgttcacaggctttatactttagaaggaaaacttgttgagagtggagcagagttggagaatgggcagttttatgtggctgttggcagagataagtttaagaaactgccttacggtgagttactttttgacaagtcaacgatgagaaggccttttggtcagaaagcttcttcactacctcctattgtaggatccagaaagtctaaagggagtggaaatgatcgccactctaagtcaacagttggatccagtgacaactcatctcctcagcccctgaagaggaaagggaaaaaagaagacgtgaattcagaaaaactgacgaaattgaaacaaaatgtaaaattaaagaattcacaagaaaccattccaaatagtgatgaaggcattttcaaagctggagcagagaggtctgaaacacggggggcagcagaagtccaagaagatgaagatactcaggttgaggttccagtcgatcagaggccagcagaaatagtagacgaggaagaagatggagagaaggcaaacaaggatgcagaacagaaagaagacttttcaggaatgaatggtgaccttgaagaggaaggaggtagggaggctacagatgcccctgagcaagtcgaggagattctggatcacagtgagcagcaggcacgccctgctcgtgtaaatggaggcaccgatgaggagaatggtgaggagctgcagcaggttaataatgagcttcaactggtcctagacaaggaaagaaagtctcaaggagctggcagtggacaagatgaggctgatgtagaccctcaaagaccaccaaggccagaagtaaaaattaccagtccagaagaaaatgaaaacaaccaacaaaacaaggactatgctgccgtggcttagaacatttttaaaaagagagtatatggatcgcaagaaaaatgaagggttatcatacttgaaagataagcacatagttattgctgaatataatgtgacactatggtcgaatactacctacgaattataacattagaagcctagtggaaagaccagataactttaaatggctactaaaggataattacttacttttattgcatgtgttttaaaagtcatatagaaatattaaataagacggacagaggagaatttgcactggaagacaattgccacttgtaaaggatgaaaaataggatcactcttattgtacgctttattataagtttagaaggcagtttattctaaataatttttctctaggaaggcgtagaattttaaagaactggtaataggaaagcatgtactattttcttaaagcaataaactcttgaatgaacagattgcgatttactttcagacataatttggagatggcagtagatcaaaatgtgtccatgacttgttaacatgcctttctttcttcctccttagccaaaatccacctttgaactacaaagacagagcaaggcgttcattttggtgggaggaagcattggttcagagtgttagtgactagtatcgccatgccgtcacttaaatgctttcaggcttgcatgcttgtggctccaatggcgcacactcaggaaggaattgtaaaggagcacccagttatattataaagcctggatgtatggtttgcagataatggaaatcctgtggattttcactgatccagtctatctttaccaatagtatctctctcttctcccttatgttattagagaacctgatattggctattccaaagattaaattattttcaaatagttttcaacaaaaataaaagtgtattaggaagaaaaaagtagactatatgaagagtttgtgactgctcaatttaacttgttttttgccttatttctattaagactgttttactatgtttttgccctagggatatcagcaaatatttatttttcctagcatgatatagttagaatttcaagcagatttctttgtaattagaaggcatctgatagaaattgtaaaactttagaagttattataatgaaaccaattcctgaatcacaacttcatggactgactaaattgatttatagttgccttgtgaggtatgtatggggaaaacataaaaacataattaaaacataatttcgtcctttttatgaattcttaagagatgttcttccataaatatagaaataatatatttttcttaaaggatatatttttaattatgtggaagttgtaagcttgaaattttaacttctagtgcttttctaaaattcacaattacaagtttaaaacattttttctcttccaggtttcatttggaataaagagttggcagttatataaagcacttaataatactatagaaaatagatgtgttttttcttaatatgattttggtattttccacagatcagaagtgtaaacagagagataatgtaacagtatttggaagagataatgacacaaggatatagtgatctgggagcatgaattagaaacagggtactatgtttctggtgtaaaatctaaattgtgctttctactagcgttactttttcaaatgggatgatataaagcactgtgggctataagcaacaatcttgggttggtaggcaaatagaccaattgatctttattattattattattattattattattattttttgagatgaagtcttgctcttgtcgcccaggctgggtgcagtggcatgatcttggcttactgcaacctctgcctcctgggttcaagcacctgagcctcccgagtagctgggattacaggcatctgccaccacacctggctaatttttgtattttttgtagagacagatgtttcaccatgttggccaggctggtctcaaactcctgacctcaggtgatccgcccgcctttgcatcccaaaatgctgggattacaggtgtgagccacagcacccggtcccagttggtcttttaatattaaatttgtgcactattactgggtctggagttaatgatttcaaatagtttctaaaaataactgattaaatgtaagaaattataactaattatcaaggtgattctcttttgtttcttcaatggagagtttctctttctcttttcctcctctaataaaaatatttctttttttcctgtccttttattcattatattatgaaacttaggttttaggaaacaccttaagcgtcattttaatgaagcacaacattgatattttacatgaataataacgtttggtattttaaatatacttcaagggggtaataagccacaataactgtaccaaaaaaacttaaaaatggggacatattcatcccttgtgtgtgcatattttaccacttgttgacaagatacaattgtgacctactttgaggggatgaataacgacttatcactttaagacactttgcaaacatgttactaaaaaaaggtgcctagccaaggaaaaaaccattcacttggaattaaaattgtggatgtcacttcagagatgactttaacataaatgctgaaagttcattcacctcacaaatgtggcagttttctctgtggagaatggtggtctccgtggcagactggctctccaaattaaatgaaactcattgacagacctgggaccttttatgtgagtggacagacaagatcttggtttggcttcatgtactgttttctagagagagtgctacgaaaaacttatgatgcttttatgtgataaccaatataatgctttaatatgttaattctttgtgatgctatatacatagtttttatagttttatgaaaccactttgttaaacttatctggattttaagacacttgtaaacaaatggtttgttagtaaaattggggcattaagagttttacagagcaaataaagaagattttgacaaaagtcaaaaaaa

SEQ ID NO: 11973 - DNA, 3837 bp, Homo sapiens
atcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtcttcctcactgaaccctgcacgttgagtaacagcagcataattccatcctaggaaagggggatgggtgttccttggaaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttattccactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgagactacagctttggaaacttaggctaagttaatttggatttgttacttgattcacctactgaccttttcttttgtttgaagtgcttatcagcataatgagctaagtgtcatgcatatttgtgaagaaacacccttgtttggtcccttttgggacagagaggtactccttgatctttatgaatgaccggttactgttttgccttattgcttaacttaatgtagtgaaataaagcagaccaagcttgaaaaaaaaaaaaaaaaaaaaaaaaaaaaa

SEQ ID NO: 11974 - DNA, 4401 bp, Homo sapiens
ccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaactaaaaaaaaaaaaaaaaaaaaaaaa

SEQ ID NO: 11975 - DNA, 4780 bp, Homo sapiens
gatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttaataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggta

SEQ ID NO: 11976 - DNA, 4491 bp, Homo sapiens
agaagcccggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctggtagtatgccctacaatcttaacagaagatggcatgcaagctcagcacctgggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgcaaaaaaaaaaaaaaaaaaa

SEQ ID NO: 11977 - DNA, 5936 bp, Homo sapiens
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattg

SEQ ID NO: 11978 - DNA, 3042 bp, Homo sapiens
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggtgggcgccccggcacggcctatggttcggtgaatctcccaagctggcacccccactccactccaagtgccaagtggttggcttgtcccgcccggtcctccctggctccagctttgtttatctgtatttttcattgcaaattgacaaattacagctgtatgtatttacgggatacaaagtgatgttataatttatgaatacaatatagaataattaatatatccaaaaaaaaaaaaaaaaaaaaaaaaaa

SEQ ID NO: 11979 - DNA, 2859 bp, Homo sapiens
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaatgaaaaaaaaaaaaaaaaaa

SEQ ID NO: 11980 - DNA, 2909 bp, Homo sapiens
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccggggtggatgaggatgttttgctttttatatggagtggcaggtttgtgagtattcattatatcattctttaccattttggatgtctaaactattcaaaaataaatgcttctatttgtaaaaaaaaaaaaaaaaa

SEQ ID NO: 11981 - DNA, 2352 bp, Homo sapiens
aggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaacttaaaaaaaaaaaaaaaaaa

SEQ ID NO: 11982 - DNA, 5066 bp, Homo sapiens
gcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacgagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaaaaaaaaaaaaaaaaaa

SEQ ID NO: 11983 - DNA, 3236 bp, Homo sapiens
ggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgctgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcggggtatgccgtcacctcagtagttttactgtaaaagggaaatttgaacaacaaaaaccaaaaaaaataaaaataaaaaacttcaaaagttgacaaaaaaaaaaaaaaaaaaa

SEQ ID NO: 11984 - DNA, 5067 bp, Homo sapiens
aggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttaaaaaaaaaaaaaaaaaa

SEQ ID NO: 11985 - DNA, 3427 bp, Homo sapiens
aggggaggaggaggcgcccgcctggttccctgcaaagcggccttatttatctgggcacagcctcagcctccccggtgggaggcttggggcggccgatcctctcccaccggggagctcctttccgtgcgctccccatgacgggaggtcgcccggcggacagcgtggcatgagccaggagcccgggccgagagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccctcccaccaccaagcctggctgctccactgtcccgggctgccctggctgggggcccgtgcaccccggcaggtggaccagcctcagccttggcacctgggcacccagcggagcggccgccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcgctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctccggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgggaacccggccatgacctgggcgggggcgcggggcgccgccgagccccctcttcccgccttgcgctcgggggagcccccgcgcccccggcccagcgcgggagacggggcgagccgagggaaagcccctccccgaccttcggtccctccgccctcccagccccgccccgggcaggggggcggcgggtgggcccgccccacgcacgcacgcacactcggggactttgtgcatgcccctcgtgcccgcactgcacgccgccctccgccacgccacagccacagccgccgccatcactcgctcgccctcccgcttggggggcggggctcggtccttgggggggctttgagctctccagactgtgcccttaccgccttccccgccacacccgctctgtcttcccactgtccccccaatcccgggcagggcccagtgggattgagggggctgggtcccccaggacacgggcccagaagagccccacgggcttcctgcatcttccaccgcaccatacctggagccctccgaggggtgtcaggggaaacaggccaccgccaaagccatggcccgccgccgagagcccaggccccacccgcacctcctcacccatccagcctgacccacgcggcctctcctcctccttgccgctgtgtggggcagtcccctgtccgccccaaaacccggccttggtccctggccaggctgagagaattgggcagggagagggcggaagggctggcgatcgcttggagtcattaacgtgatccaagctgactccggtcggcctcaacccaggggtggcgcaggcaccttgcaagcctcgagctgtagccaccctcaggcctgggaagaggcctgggccgacctcacacctcagcccttgcacccggccgggctcagttcaggcctgggcaccgagcttcaccctgggtgggtctcctcaggtggagtctgcagagtggacccagccaagggtcagggtcagcactgggtcagcgactccaatcttccagtggccagcacaccctagacaccccgaggagggagggctcctttctagcctgcccccccacccccacttcacccctccccagcttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagagtgagagagagaaagagagtgagagagagagagaaagagagagagagatgctgttgaatcagaaacagatcaacagcccaaagattttcctgtccctggagtgccagccccaggaagctccagggctgagtggtcaggagccagtttctccagcccctcctccccacaacccctagtggggaggggcagctgtccatttgcccaaagtattaatgcaactgaagctgtgatatttccaacgactgtaggaggaaaaattaaggggagagaggaaaacaaaaccaaccaacccctaaaatcattttcttattgtacataacgacctcattctcctgtatatgcggaagatataaccttatatttggtaagtgtttcttgtgctattttatcacgtgacctgtttataaaaatatatattaaaaaagttgtaaaaaaaaaaaaaaaa

SEQ ID NO: 11986 - DNA, 1333 bp, Homo sapiens
acattttctaatgtttacagaatgaagaggaacagtttatctgttgagaataaaattgtccagttgtcaggagcagcgaaacagccaaaagttgggttctactcttctctcaaccagactcatacacacacggttcttctagactgggggagtttgcctcaccatgtagtattacaaatttttcagtaacttcctttactagatcgggcctgtgcatcttctgtatgtaggaggtggaatgaagtttttcatatttctgacctttggagaaagtttgaatttgaactgaaccagtcagctacttcatcttttaagtccactcatcctgatctcattcagcagatcattaaaaagcattttgctcatcttcagtatgtcagctttaaggttgacagtagcgctgagtcagcagaagctgcctgtgatatactctctcagctggtaaattgttccatccagaccttgggcttgatttcaacagccaagccaagtttcatgaatgtgtcggagtctcattttgtgtcagcacttacagttgtttttatcaactcaaaatcattatcatcaatcaaaattgaagatacaccagtggatgatccttcattgaagattcttgtggccaataatagtgacactctaagactcccaaagatgagtagctgtcctcatgtttcatctgatggaattctttgtgtagctgaccgttgtcaaggccttagagaactggcgttgaattattacatcctaactgatgaacttttccttgcactctcaagcgagactcatgttaaccttgaacatcttcgaattgatgttgtgagtgaaaatcctggacagattaaatttcatgctgttaaaaaacacagttgggatgcacttattaaacattcccctagagttaatgttgttatgcacttctttctatatgaagaggaattcgagacgttcttcaaagaagaaacccctgttactcacctttattttggtcgttcagtcagcaaagtggttttaggacgggtaggtctcaactgtcctcgactgattgagttagtggtgtgtgctaatgatcttcagcctcttgataatgaacttatttgtattgctgaacactgtacaaacctaacagccttgggcctcagcaaatgtgaagttagctgcagtgccttcatcaggtttgtaagactgtgtgagagaaggttaacacagctctctgtaatggaggaagttttgatccctgatgaggattatagcctagatgaaattcacactgaagtctccaaatacctgggaagagtatggttccctgatgtgatgcctctctggtaatgggctg

SEQ ID NO: 11987 - DNA, 1702 bp, Homo sapiens
ctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaaaaaaaaaaaaaaaaaaaaaaaaaaaaa

SEQ ID NO: 11988 - DNA, 1578 bp, Homo sapiens
gcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcaaaaaaaaaaaaaaaaaa

SEQ ID NO: 11989 - DNA, 810 bp, Homo sapiens
gcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataa

SEQ ID NO: 11990 - DNA, 3178 bp, Homo sapiens
gtgaaagaagcacatttggagaaagaggagaagaggcccaggtgttctgtggctcaggggcaagctctgagctccctgagcaatggccccatgctccgggactcagaggccgaggttactgaggaggatcccaggctgcgggcccagcagctccatcaccgggtgctgaccctgcagtgccagctcagggaccagggcgctgcccaccaggcgtctctggacgaggccacccgcctccaggaggagctccaggccaagcttgaagaacttcagaaaaagcaacatgaagcaaagttggcagtgactcccctgaaggccaagatagcttccctcgtccggaagtgccgggagaggaaccgcctgatcacccacctgctgcaggagctgcacagacatgggctggggaacctcctgctctccgagctggcgcagaacatgctcaacgacgtggcactggctgagtacacggccaccttcctggctccgggagtcccagagacaagccaccacctggacgtcaagtctgagatgacggcagctttaagagctcagacatacctcttgaatcctgaaatggacagtgtcctccaaagctcattgtcttcagagtcctggcctattcccgagccggagtggccagcacagacagcccaactggattctctgaagctccctctgtccttggtgtccacgcttgatcctggaacgtgcctggcagcggtcactgtggaaccaggtctccccgcacaacgtctgcaagaaaaaggcggaatgccctgtcctgccctccaagtcgataacgtcccagcaccctctgagctcctgagcccagcaaggatcctggcttttcaccaagagcttagacaaagcatttgcagcaattcccaggtccataaatcaccgctggagttagaaatgtaatagggccactcattctccggagccatttcatagactccataaatatttgaagcagaaccttcagagagtgctttaagaaattggtagcaatcagagccctcatttagtggcaagtggttttgccttcggctttgggattttgtgttcattgtcagagcttgagagaaacgctggcctgtgcctggcaaattctgaggagtttggctttggcaatgtcaaggcagcataggaaatatttactgtaccaaaacctattgaatgattggtccagaggttctcaactgggcacagttttagccccccagggaaaatctggccatgtctggagacatttttggttgtcacagctgggacactgctactggcatctggtgggtagaggccagggatgctatgaaatgtcctacaatacccaggccagcctcctacagcaaagaattacagcccgagggtcgccagtgctgaggtcgagagtccaggacggatctcatagctcccaacaagatcagccatggagaattgttttgttttgttttttctctgcccccggggtccttcccatgttttaaaagattttttgtctactaagtgaaacgcctaagtcaccatatattttacatttaaaaacattaaaactaaccagaactttctaatcagtccatccactccaaaaacgtctgttgatatccactggatgccaggcaatgtggcatgaaggagaagagacaagtcaatgttgatcctggcgctggggacctcacaggacaatgggagagatactcctgtgagtaaatcagcacgcacgcaagtgtcacatgtgccctgagcaacgggatgaaggtaagggtccgttctacttggcttgggacaactggaagtcagccacaaaggaatggctgggcagtgtccggtgggtgaggtgggaagggtgctgctgtacgagggaacgcatgtgcaaaggccctgaggcataaaactgaactgtggatgtgcccctggaggggaagtgggcaaagcatgctcttgtcaagccagctgcaagcagtcactgcatcgttcccatccagcaccccttccttccaccgagaacagagactcgtgccccgaatcaggtgggcgacccaggagaagagcacttctatcctgagggcagccccccaaaaagagagtctagggagcttggacgacacacaccagaccctgacccaggctcacccaccagagatgtcacctctctctttgggaaggggctgaggaggggcttaagggaaaggccaaagccgctacctgtccaattctgtcctctcctggaagtgactgtcccttcacggaaggacaaacaaggacaaggacaaggaactgacggctccccaggaagtgtcaaagtgtatagatttattttaacgtagtttagctttttgtttgaaatgaaaattacacagagttcccgtagactcttccccgggcttcccttgatgttaacatctcatgtgacttatgttgtacaattatagaaactagtgggttttatttcgaggaaaattggggagccattgagacgtaagaaaggcagcctcagcacattgagttccaccctttaaattcgtttatggggttttctgatgggttagcacattcatccatgtattcctggattgatttacccacagatctgtctatttatttatttattcaatatgcatttagtgactgctgtgcgagtgtctggctggatgctgctggggaagaagtgaagatgatgctgtccacctaggttttcagggacccccctggagaccctgtggccccgttaccacccctcaagaatccccagattggaaaccactgcggtgatccctttgttggttcaaccaccccagggcttccctataatttccaagcaggaagtgacctgcagcactggtttggtgatccgccttctgcctccctctgtattttgggacaacgtcattagctttgagcatcaggaacatgacagagagaggacagaaacccggtgcagccgaggacagccagctgagcccttgctgagccagcgagatgcagcgtggtgccaccacatctggtctccaggagtcccaggagctcagacgtccgtcgtcttgtgacttcatgctcccctctgccgcgctcacgtgctgggcctgggcagaaaggcaacccaggaaatccattaaagcaagccaagacgacctttgcagcgtaacccaacgattccctaataaatcatgtttcc

SEQ ID NO: 11991 - DNA, 6894 bp, Homo sapiens
tgacccggtccgtgtgggccagcgggaaggaagccagttgagggaagttctccatgaatgtacgtcacaatgatgatgaccgaccaaatccctctggaactgccaccattgctgaacggagaggtagccatgatgccccacttggtgaatggagatgcagctcagcaggttattctcgttcaagttaatccaggtgagactttcacaataagagcagaggatggaacacttcagtgcattcaaggacctgctgaagttcccatgatgtcacccaatggatccattcctcccattcatgtgcctccaggttatatctcacaggtgattgaagatagtactggagtccgccgggtggtggtcacaccccagtctcctgagtgttatcccccaagctacccctcagccatgtctccaacccatcatctccctccctatctgactcaccatccacattttattcataactcacacacggcttactacccacctgttaccggacctggagatatgccgcctcagttttttccccagcatcatcttccccacacaatatatggtgagcaagaaattataccattttatggaatgtcaagctacatcacccgagaagaccagtacagcaagcctccgcacaaaaaactgaaagaccgccagatcgatcgccagaaccgactcaacagacctccttctgctatctacaaaagcagctgcacaacagtatacaatggctatgggaagggccatagtggtggaagtggcggaggcggcagcggtagtggtcccggaattaagaaaacagagcgacgagcaagaagcagcccaaagtcgaatgattcagacttgcaagaatatgagttggaagtaaagagggtgcaagacattctttcgggaatagagaaaccacaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacagtggagaagaattagaatgtaacctgaaagatcttagaccagcaacagattatcatgtgagggtgtatgccatgtacaattccgtaaagggatcctgctccgagcctgttagcttcaccacccacagctgtgcacccgagtgtcctttcccccctaagctggcacataggagcaaaagttcactaaccctgcagtggaaggcaccaattgacaacggttcaaaaatcaccaactaccttttagagtgggatgagggaaaaagaaatagtggtttcagacagtgcttcttcgggagccagaagcactgcaagttgacaaagctttgtccggcaatggggtacacattcaggctggccgctcgaaacgacattggtaccagtggttatagccaagaggtggtgtgctacacattaggaaatatccctcagatgccttctgcaccaaggctggttcgagctggcatcacatgggtcacgttgcagtggagtaagccagaaggctgttcacccgaggaagtgatcacctacaccttggaaattcaggaggatgaaaatgataaccttttccacccaaaatacactggagaggatttaacctgtactgtgaaaaatctcaaaagaagcacacagtatacattcaggctgactgcttctaatacggaaggaaaaagctgtccaagcgaagttcttgtttgtacgacgagtcctgacaggcctggacctcctaccagaccgcttgtcaaaggcccagttacatctcatggctttagtgtcaaatgggatccccctaaggacaatggtggttcagaaatcctcaagtacttgctagagattactgatggaaattctgaagcgaatcagtgggaagtggcctacagtgggtcggctaccgaatacaccttcacccacttgaaaccaggcactttgtacaaactccgagcatgctgcatcagtaccggcggacacagccagtgttctgaaagtctccctgttcgcacactaagcattgcaccaggtcaatgtcgaccaccgagggttttgggtagaccaaagcacaaagaagtccacttagagtgggatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatccccctgcttctgtttttgtatatttttgctacttggtttttcttgatcatagctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggccttctgatgctctgactcttctctgtatgtcaaactcatccctggcacaagaaattccagtcatgtgaagcaaactgccctttgtcctcaaagaaattgttgaaaaagaaaactttttaaagagattttttgcatattctctgccttgttcttatcaacttgaaatgttggcattttctaaccttgttttgttggctacaataattcagtattcatgtcaaaattgagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtgtatatgtaatatatttatgcccaataaatgttttaattctttctga

SEQ ID NO: 11992 - DNA, 454 bp, Homo sapiens
atgccactctgggtgttcttctttgtgatcctcaccctcagcaacagctcccactgctccccacctccccctttgaccctcaggatgcggcggtatgcagatgccatcttcaccaacagctaccggaaggtgctgggccagctgtccgcccgcaagctgctccaggacatcatgagcaggcagcagggagagagcaaccaagagcgaggagcaagggcacggcttggtcgtcaggtagacagcatgtgggcagaacaaaagcaaatggaattggagagcatcctggtggccctgctgcagaagcacagcaggaactcccagggatgaagattcctcctgtgacccgggctacctgtagccaaaatgcaactggatccagttaatcctctcatttctgacccactttttcctttgaaaatacaataaaattcccccataccggtgtgcatttaaa

SEQ ID NO: 11993 - DNA, 1993 bp, Homo sapiens
ctagttaaggcggcacagggccgaggcgtagtgtgggtgactcctccgttccttgggtcccgtcgtctgtgatactgcagttcagccatggcagaaccgcagcccccgtccggcggcctcacggacgaggccgccctcagttgctgctccgacgcggaccccagtaccaaggattttctattgcagcagaccatgctacgagtgaaggatcctaagaagtcactggatttttatactagagttcttggaatgacgctaatccaaaaatgtgattttcccattatgaagttttcactctacttcttggcttatgaggataaaaatgacatccctaaagaaaaagatgaaaaaatagcctgggcgctctccagaaaagctacacttgagctgacacacaattggggcactgaagatgatgcgacccagagttaccacaatggcaattcagaccctcgaggattcggtcatattggaattgctgttcctgatgtatacagtgcttgtaaaaggtttgaagaactgggagtcaaatttgtgaagaaacctgatgatggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaaccttatttatttgggaaaggggaggaggaaggaaatgatatggtacccagacactgggctaggctgcaactttatctcatttaatactcccagctgtcatgtgagaaagaaagcaggctaggcatgtgaaatcactttcatggattattaatggatttaagagggcatcaatcagctcaactcaagatttcataatcatttttagtatttagattgtgcctcaaagttgtagtacctcacaatacctccactggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataag

SEQ ID NO: 11994 - DNA, 3582 bp, Homo sapiens
gcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggcaaaaaaaaaaa

SEQ ID NO: 11995 - DNA, 3494 bp, Homo sapiens
gcctactttggtgcagaggcgtggggggcgggacgcgtctttcccgttcggatcgcggggaaagcagtggctccaagtgagccagaggagagctgaggagaggagggggaggccgacgacctgggccctgggcctctgaaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactggatattgactctaactcttattcccaagcttatatccttaatcacctaaagatcagagtgtgaagaaacaaacctgtgacagatctgtggttgaggtttagactacgggaggagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagcttaatgcatcctccaggccccaaacctgggacgaggtcactgttgaattcaaacctggtctttttcatggggttggcttccgatccacaagcccctttggaattcccgaagaggcttctgaaatgcttgaggcaaagcccaagaacctggaacttagcccagaaggagaagagcaggaatctttgcttcagcctgatcagcctagtcctgagttcacatttcagtatgatccttcctaccggtcagtccgggaaattcgagagcatcttagggccagggagagtgcagagtctgagagttggtcctgcagctgcatacaatgtgagctgaaaattggttctgaagagtttgaagaattccttttattaatggacaaaattcgggatccttttattcatgaaatatctaaaattgcaatgggtatgagaagtgcttctcaatttacccgagatttcattcgagattcaggtgttgtctcacttattgaaaccttgcttaattatccatcctctagagttaggacaagttttttggaaaatatgattcacatggctccaccttatccaaatctaaacatgattgagacattcatatgtcaagtgtgtgaggaaacccttgcacatagtgtggattcccttgagcagctgactggaataaggatgcttagacacctcactatgactattgactatcacacactgattgccaactatatgtccgggtttctctccttattaaccacagccaatgcgagaacgaagtttcacgttctgaaaatgctattgaatttgtctgaaaatcctgctgtggcaaaaaaactattcagtgccaaagctctttcaatatttgtgggtctctttaacatagaagagacaaatgataatattcaaattgttattaaaatgtttcagaatatcagtaacattataaaaagtggaaagatgtccttaattgatgatgatttcagtcttgagccgcttatttctgcatttcgtgaatttgaggagttagctaagcaactacaagcccaaatagacaaccaaaatgatcctgaggtgggacaacaaagttaatatgattaaccacctgccgctgatcagccttatgttcccaaagagccctgagtagtgctttggtgttcacagtctgtttttttgttgtaacttatattttttaatgctgatgttaactttgtcaaactcttgttttgagctggatcattttgtggatgccaaatgaatatcaaaactgaaaacacatttgttgatatttgtcttgctgtccagattgcggtatttttcagtattaagttttcaatgaactgtgtcacctaagtaagctaccctgctattcgttgtttaaatatatggttctctatttgagtctgtgttttcaataaagttctatgttaaaattggcaaaaaaaaaaa

SEQ ID NO: 11996 - DNA, 2870 bp, Homo sapiens
aggtcgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtgggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctaatgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaaaaaaaaaaaaaaaaaaaaa

SEQ ID NO: 11997 - DNA, 2440 bp, Homo sapiens
cttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctaggccctagcagccagaatgtcactgaatacgtcgttcgagttcctaagaatacaaccaaaaaatataacatcatggcttttaatgcagccgacaaagtcaactttgctacgtggaatcaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggaggggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccagtagctcccaagaagagcctgagagcaaggccaaggcgccgcagcaggaggaggggcccaagggtgtcgatgagcagagcgacagtagtgaggagagtgaggaggagaagccgcctgaggaggacaaggaggaggaggaggagaagaaggcacccaccccgcaggagaagaagcgcaggaaagacagcagcgaggagtcggacagctcagaggagagcgacattgacagcgaggcctcctcagccttcttcatggcgaagaagaagacgccacccaagagagagcggaagccgtcgggagggagctcaaggggcaacagccgcccaggcacgcccagcgcagagggtggcagcacctcctccaccctgcgggcggctgccagcaaactcgagcaagggaagcgggtgagcgagatgcctgcagccaagcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaatt

SEQ ID NO: 11998 - DNA, 2753 bp, Homo sapiens
gagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaactaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaaggatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagttaaaaaaaaaaaaaaaaaaaaaaaaaaaaaaaaaaaaaaaaaaaaaaaaaa

SEQ ID NO: 11999 - DNA, 1696 bp, Homo sapiens
ttctttagcctgaactgtgggtagtgatgtggtgtgtttcctaacacctccggcagtgagccaggctttgagtggctgcgtctaaacacttctttccctgaggactggaagacattagaataagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactgg

SEQ ID NO: 12000 - DNA, 1476 bp, Homo sapiens
ttctttagcctgaactgtgggtagtgatgtggtgtgtttcctaacacctccggcagtgagccaggctttgagtggctgcgtctaaacacttctttccctgaggactggaagacattagaataaggtccagaaatgtccttggtgtgtttgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactgg

SEQ ID NO: 12001 - DNA, 577 bp, Homo sapiens
cacaattgacagcctcaaggttcctggctttttgaaccaccacagacatctcctttcccggctaccccaccctgagcgccagacaccatgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcgcaggcgcagagccagcgccgcgcccctgcctcgggcgccgctgttccgccccggccgccgcctccgtcgcgcccggaggacagtccgggatctgagtcgttcttcgggccctgtcctggcccaggcctctgccctctgcccacccagcgtcagcccccagaaaaaaggcaataaagacgagtctccatt

SEQ ID NO: 12002 - DNA, 4099 bp, Homo sapiens
gggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgtt

SEQ ID NO: 12003 - DNA, 2396 bp, Homo sapiens
agtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagcagacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagcagagtctgaggatatacttcagggactctgtgaacccctcacaattgtatgccaactttgtgtgcttatgtgtacatgcatttttcttggggcgagttcataattttaatcaaattctcataggggctcatgacccacaataggatacaaacgaagagtttaagccagcatgatccagatgggttcatcagtctggtcagtgagaaagggccgagggtagacaggcagcttctgtggttcagcttgtgacatgatatataacacagaaataaattatgcttgtccctga

SEQ ID NO: 12004 - DNA, 6311 bp, Homo sapiens
gtggggacgttgacaagtggatccaagatggcgtagaaagtaatgacaggatttggatgaagtaatggatcactaatgaactacagtgctggtgagatgtgtaagaaattataaagagctctgatgggctatttgggtgatacccagtgcagtgaactgcaggatttttgtccctgagtcatggaagacagaagagctgaaaagtcatgtgaacaagcatgtgaatcacttaagaggcaggactatgaaatggccctcaagcactgcacagaggcccttctttctcttggccagtactccatggcagacttcacagggccttgtccattggaaatagaacgcatcaaaatcgagagtcttctctacagaattgcctcatttttgcaactgaaaaattatgtgcaagctgatgaagattgtagacatgtgctgggagaaggactggccaagggagaagatgcctttcgggcagtgctttgctgcatgcagctgaaagggaagctccaacctgtatccaccattcttgccaagtcactcacaggagagtccctgaatgggatggtaacaaaggatttgacaagactaaaaacacttctctcagaaacagagacagcaactagtaacgccctctctggatatcacgtggaagacttagatgaggggtcttgtaatggttggcatttccgcccaccacctaggggaatcacaagcagcgaggaatatactttgtgtaaaagatttttagaacaaggaatctgtaggtatggtgcccagtgtacttcagcacattcccaggaagaactagcagaatggcagaaaagatatgcttcacggctgataaaattgaaacagcaaaatgagaataaacagctctcaggcagttacatggaaaccttgatagaaaagtggatgaattcattgtctcctgagaaagtgcttagtgaatgtatagaaggagtaaaggtagagcacaatcctgacctgtcagttactgtcagcaccaaaaaatcccaccagacatggacctttgctctcacttgtaagcctgcaagaatgctgtatcgtgtagcattgctttatgatgctcatcgtcctcattttagtatcattgcaatatctgccggagatagtactacccaggtatcacaagaagtcccagaaaactgtcaagaatggataggaggaaagatggcccaaaatggattagatcattacgtgtataaagtcgggatagcatttaacacagaaatatttggaacttttcgccaaaccatagttttcgactttggattggaaccagtactcatgcaaagagtaatgattgatgcagcttctacagaagatctcgaatacctgatgcatgcaaaacagcagctagtaaccacagctaaacgttgggattcttcctctaagactattatagattttgaacctaatgaaactactgatttggagaagagccttcttatcagataccaaattcccctctctgctgaccagctatttactcagtccgttttagacaaatcattgaccaagagcaactatcagtcacggttacatgaccttctttatattgaggagatagcccagtataaagaaatcagcaagttcaaccttaaagtgcaattgcagattctggcaagcttcatgctcactggtgtttctggaggtgcaaagtatgctcagaatggacaactttttggtcgctttaagcttactgaaacactttctgaagatactttggctggacgactggtgatgaccaaagtcaatgctgtttatttattaccagtccctaaacagaagttagtacagacccagggaaccaaagagaaggtttatgaagctactattgaagaaaaaacaaaggaatatatatttttaaggctatctagggaatgctgtgaagaacttaatcttcggcctgactgtgacacacaggttgaacttcagtttcaattaaatcgattacccctctgtgaaatgcactatgcactagacaggatcaaggacaatggggttttgtttccagacatcagtatgactcccaccataccatggagtcctaacagacaatgggatgaacagttggatcctcgactaaatgcaaaacagaaagaggctgttctggccattaccactccacttgcaatccagctgccgcctgtgcttatcatcggaccctatgggacaggcaaaacgttcactctagctcaggctgtcaaacatattctgcagcaacaggagactaggattctcatttgcacccattctaatagtgctgctgatctctacataaaggattatttacatccatatgtagaagcaggcaatccccaggcaagacctctcagggtatatttcagaaatcgctgggtaaagactgtccacccagttgtgcatcagtactgtttgatctcaagcgcacattccacctttcagatgccccagaaagaagatattcttaaacatcgagtggtggttgttaccttgaatacttcccagtacctctgtcagttggaccttgaacctgggttttttacacacattctattagatgaagctgcccaggccatggagtgtgaaaccattatgcctctagcattagcaactcaaaacactcggattgtcttggctggtgatcacatgcagctcagtccttttgtttacagcgagtttgccagggagagaaaccttcacgtttcattacttgaccgactctatgagcattaccctgctgagttcccatgtaggattctcctgtgtgagaactaccgctcccatgaagctatcatcaattatacctctgagcttttctatgagggcaaactgatggccagtgggaagcagccagcacacaaagatttctacccactaactttctttacagcacgaggagaagatgtacaagaaaaaaatagcacagctttttataataatgcagaggtgtttgaagtggtggaacgtgtagaagagttaagaaggaagtggccagtagcgtgggggaagttagatgatggcagtattggtgtggtgactccatatgctgatcaagtgtttagaatacgtgctgaacttcgaaaaaagagattatctgatgttaatgtagaaagggtgctaaatgttcaaggaaagcaattcagagttttgtttcttagcacagtacgtacaagacatacttgtaaacataaacagacaccaattaaaaagaaagagcaacttctggaagattccacagaggacttagattatggttttttatctaactacaagcttctcaatactgccatcacaagagcacaatccctggttgctgtggtgggtgatcccattgctctgtgctctattggaagatgcaggaaattttgggaacggtttattgccctgtgtcatgaaaacagtagcctacatggaatcacttttgaacagatcaaagcccagttagaggctttagaactaaagaagacatatgtgttgaatccgctggcacctgaatttatcccccgggctctaagactgcagcattcaggaagtaccaacaaacagcagcaatcaccacccaaggggaaaagtcttcatcatacccagaatgatcacttccagaatgatggaattgttcagcccaatccttctgtacttattggcaatcctattagagcatatactcctccaccccctcttggacctcacccaaatttgggaaaatctccaagccctgttcaaagaatagatcctcacactgggacaagtattctttatgtacctgctgtctatggagggaatgtagttatgtcggtgcctttacctgtaccatggacaggataccagggtaggtttgcagttgatcctcgaattattacacatcaggcagcaatggcctataacatgaacctattacagacacatggacgaggatctcctattccttatggccttggacatcacccacctgtcaccataggccagccacaaaatcagcatcaggagaaggatcaacatgagcaaaatcgaaatggtaaaagtgatacaaataattccggacctgaaattaataagattcgaacaccagagaaaaagccaacagaaccaaaacaggttgatttggaatcaaatccacagaacagaagtcctgaatcacgtcctagtgttgtttatcccagtaccaaatttcctcgcaaagataatctcaacccaagacacataaatcttccccttcctgctccccacgcacagtatgcaatccctaatcgccactttcatccccttccccagctaccaagaccaccctttccaattccacagcagcacaccttgttaaatcagcagcagaataatttgcctgaacaaccaaatcagataccacctcagccaaatcaggtagtccagcagcaaagtcagttgaatcagcagcctcagcagccacctcctcagctttctcctgcatatcaggcgggacccaacaatgctttttttaatagtgcagttgctcatcggccacagtctcctcctgcagaagctgtaattccggagcagcagccccctcccatgctgcaagaaggccacagtcctctgagagccattgcacaacccggccccattcttccttcacatctgaatagcttcattgatgagaacccctcgggattacctataggggaggctttagatcgtatacatgggagtgtcgctctggaaacattaaggcagcagcaggcacggttccagcagtggagcgagcatcatgcctttctcagtcagggcagcgttccatacccacaccatcaccatcctcacctccagcatcttcctcagccgcccctgggattacatcagccgccagtgagggcagactggaagctcaccagcagtgccgaagatgaagtggagaccacatactcaaggtttcaagacttaatcagagaactgtctcatcgtgatcaaagtgaaacacgggaactagctgaaatgccaccacctcaatcaagacttttgcaatatagacaagtacagagtagaagcccaccagcagtcccatctcccccatccagtacagaccacagtagccacttttctaactttaatgataacagcagagacattgaagtagccagcaacccagcatttccacagcgcctcccaccccagatattcaactcacctttctcgttgccatctgaacaccttgcccctcctcccttgaaatacctggcacctgatggagcatggacttttgctaacttgcaacagaatcacctaatggggccaggttttccctatggcctacctccattgcctcacaggccaccgcagaacccttttgtacaaatacagaatcatcaacatgctattggtcaagagccatttcacccattgtcatctcgaacagtatcttcttcttcgctccctagcttagaagagtatgagcccagaggacctggtcggcccttgtaccaaagaagaatctcatctagctcagttcaaccttgttctgaagaagtaagcactcctcaagacagtctggctcagtgtaaagagcttcaggaccacagtaaccaatcttctttcaacttttcatccccggagtcctgggtaaacaccacctcatctactccttatcagaacattccgtgcaatggatccagcaggacagctcagcccagagagttgatagcgccacccaagactgtcaaaccccctgaggatcaactgaagtcggagaacctcgaggtgtccagttccttcaactacagtgtgctgcagcatcttggccagtttccaccccttatgcctaacaagcagatcgcggagtcggccaatagcagtagcccccagagctctgcggggggcaagcccgccatgtcctatgccagcgctctgcgggcccctccaaagcccaggccccctcctgagcaggccaagaagagtagcgaccctctgtctctcttccaggaactgagcctagggagctcatctggcagcaatggcttttactcatattttaaataatcactttttttttccctcaagggagaatgttttaatttctgtttgtatcagtagaattaaggtagttggacttcatctatagatgcacagttccctttgttttaatattaaatatgttctcacttaattgctttgctgctagacttgcaactaatttttttaaagtatattccattattttgcatttttgatgtgtcaaaactttgacagcttttatgtagaataaaaaaatttttaaatttgtgtattgttacatatgtttgcatcaagctagcagccaagaggttaattgtgcaactata

SEQ ID NO: 12005 - DNA, 4883 bp, Homo sapiens
acgcgcatggaacgcagcgaaggactatggcaggggagaacttcgctacgccgttccacgggcacgtgggccgcggcgccttcagcgacgtgtacgagcccgcggaggacacgtttctgcttttgaacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcaaaaatggtcgggaagtcatggacaggttttttcccctggttccagatctcctttcaccaaaaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttcagatggcagggccagcaacacaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggatccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttataccagcctgtttaccaattgactcaaaaagctgctagttttgagtagggcccagaacaagaaaagagtctgcaacaggtccaggctgctgtgcaagctgctctgccacttgggtcatatgatccagcagatccagtggtgtttcagtggcagtggcagatagggatgctgtttgaagcttctggcaggtccctataggtgaatcttggtttaggattttagagcaaagccgtgccattaccaacaaataactagtctctttttgagaaacagctcttggcctgctactgggccttagtagagactgatacttaatgagtcaccaagttaccgtgcaacctgagcttcccatcatgaactggatgttatctgagccaccaacgcacaaagttggatatgcacagcaacactctgtcatcagatggaagtggtatacacatgattgggcctgagaggccctgaaggcacaaggaagttacatgaagaagtaggccaaatttccgtagtccccacttctgctacctgccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatactagtaggcctctttctccagccacacctgtcatcacccaattgtttcatgagcaaagtagccatggtgacaagaatagaggttatgcatgggctcagcaacgtggacttctactcaccaaggctgacctggccaaggctatctctgagtgcccagtctgccagcaacagagaccaacactgagcccctgatatgacaccattccccagggtcatcagtcagttgcctagtggcaggttcattacattgatccacctctatcattgaagggatagtgttttatccttactgaaatagatcttactctggatacagattcactttcccttcgcgcagggtgtctgctaaaactaccatccgtggacttacagaatgtctcatctatgaccatggtattccacacagcattacaagaaactcagttcacagcaaaagtgtggcagtgggcccatgatcatggaattttcttaccatgttccctactatcttgaatcaactggctacatagagcagtggaatggcattttgaagacagtaataacaccagctatatagcagtgccttgtagggctgggacaaggttctctagaagactgtctatgctctgaatcaacatccagtatatggtgcatttctcttatgactgggattcacaggtccaggaatcaaggggtcagaataggaaggacaccattcgctattagccctggtgacccactagcaaaatttttgcttcctgttcccatgacttatgcactgctggcctagaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttaaagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaagaattccccccccttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattaaaccaatctataaaacagatagctatgaaagagaaaggtgacaggcacaagcctaggcaaatagagaagggttcctggacagcctctgacttgcctaggtcattgtgcacacgtggcttgcctgaatgaacatgcccactgtgaaagattccatttctcaacacatgtgcagtaagggaaataaatcaatgtggctcaaactaaccgcccacacatggggtggagccacaaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgccaaaaaaaaaaaaaaaaaa

SEQ ID NO: 12006 - DNA, 4799 bp, Homo sapiens
acgcgcatggaacgcagcgaaggactatggcaggggagaacttcgctacgccgttccacgggcacgtgggccgcggcgccttcagcgacgtgtacgagcccgcggaggacacgtttctgcttttgaacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtaggaagtcacggaatagaggcagcttgggctggtggcaaaaatggtcgggaagtcatggacaggttttttcccctggttccagatctcctttcaccaaaaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttcagatggcagggccagcaacacaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggatccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttataccagcctgtttaccaattgactcaaaaagctgctagttttgagtagggcccagaacaagaaaagagtctgcaacaggtccaggctgctgtgcaagctgctctgccacttgggtcatatgatccagcagatccagtggtgtttcagtggcagtggcagatagggatgctgtttgaagcttctggcaggtccctataggtgaatcttggtttaggattttagagcaaagccgtgccattaccaacaaataactagtctctttttgagaaacagctcttggcctgctactgggccttagtagagactgatacttaatgagtcaccaagttaccgtgcaacctgagcttcccatcatgaactggatgttatctgagccaccaacgcacaaagttggatatgcacagcaacactctgtcatcagatggaagtggtatacacatgattgggcctgagaggccctgaaggcacaaggaagttacatgaagaagtaggccaaatttccgtagtccccacttctgctacctgccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatactagtaggcctctttctccagccacacctgtcatcacccaattgtttcatgagcaaagtagccatggtgacaagaatagaggttatgcatgggctcagcaacgtggacttctactcaccaaggctgacctggccaaggctatctctgagtgcccagtctgccagcaacagagaccaacactgagcccctgatatgacaccattccccagggtcatcagtcagttgcctagtggcaggttcattacattgatccacctctatcattgaagggatagtgttttatccttactgaaatagatcttactctggatacagattcactttcccttcgcgcagggtgtctgctaaaactaccatccgtggacttacagaatgtctcatctatgaccatggtattccacacagcattacaagaaactcagttcacagcaaaagtgtggcagtgggcccatgatcatggaattttcttaccatgttccctactatcttgaatcaactggctacatagagcagtggaatggcattttgaagacagtaataacaccagctatatagcagtgccttgtagggctgggacaaggttctctagaagactgtctatgctctgaatcaacatccagtatatggtgcatttctcttatgactgggattcacaggtccaggaatcaaggggtcagaataggaaggacaccattcgctattagccctggtgacccactagcaaaatttttgcttcctgttcccatgacttatgcactgctggcctagaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttaaagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaagaattccccccccttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattaaaccaatctataaaacagatagctatgaaagagaaaggtgacaggcacaagcctaggcaaatagagaagggttcctggacagcctctgacttgcctaggtcattgtgcacacgtggcttgcctgaatgaacatgcccactgtgaaagattccatttctcaacacatgtgcagtaagggaaataaatcaatgtggctcaaactaaccgcccacacatggggtggagccacaaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgccaaaaaaaaaaaaaaaaaa

SEQ ID NO: 12007 - DNA, 1061 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaaaaaaaaaaaa

SEQ ID NO: 12008 - DNA, 1143 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaaaaaaaaaaaa

SEQ ID NO: 12009 - DNA, 6355 bp, Homo sapiens
atgaatcattcacaactgaagccttgcattattaatatcgttattctcagacttctaaggagggcccagctggatcccatatatggaaggcgcgactcagcctccggggcaagcacctccctgggtccggagttgccatggagtcccgcaggcggcctggaggcggtgccccgggctcggcccccgcgcaggtccttggtctgcggcctgggtcctgcccgcgccggggtccacccagcccgcctttgcgccggcccagggccgctcccctgggaccctgggggacagacagaagctggtggggactggcgcgggcgtcctcgggagagcgccgggcgcgctgggcttgctgaagggctccaggcctggccattcggtgacttccaaagaggggacgcgccgcggggccccgagggcctgaaatccgctcccgcagcgcagccccgggcgcgccactacccccgccgcggtcgactgcggggcgaccgctcggtcccgaagccgggagaggagaggccgggcctcggcgggccgctctgggcgggcggggagcgcagctccggagccaggcagttccccgcgcccgccttccccgacctttcccggccggcccgagctcggagggcgctcccgctgcccggcggctcagacacggcccgagcgccgccgcggacgcggacagagacccgcacgggcacgggcgctgcgctggaggctcccctcgcggtccggggctgcgcgaccatggcggacaaggaggccggcggcagcgacgggccccgagaaacggctcccacatctgcatattcatctccagcccggagtcttggggacacaggaataacgcctctgtccccctcccatattgtgaacgacactgactccaacgtctcagaacagcagtcatttctcgtggtggtggccgtcgactttgggaccacatccagtggctatgcctacagcttcaccaaggagccggaatgcatccatgtgatgaggcgatgggagggaggtgaccctggtgtgtccaatcagaagactccaaccaccatcttgctgactcccgagaggaagttccacagcttcgggtatgccgccagggacttttaccatgacctggatcccaatgaggccaagcagtggctgtacctggagaagttcaagatgaagctgcacaccactggggacctcaccatggatacagacctgacggcagcaaatggcaagaaagtcaaagcccttgaaatctttgcttatgccctgcagtactttaaggagcaggcgctgaaggagctgagtgaccaggcgggttcggagttcgagaactctgatgtcagatgggtcatcacggtgcctgccatctggaagcagccggccaagcagttcatgagacaagctgcctaccaggcaggcctggcctcccccgagaactcggagcagctcatcattgccttggagcctgaggcagcctctatctactgccgaaagctgcggctacaccagatgattgagctgagcagcaaggcagccgtcaatgggtacagcggcagtgacacagtaggagctgggtttacacaggctaaggaacacatacggcgtaatcggcagagtcggacctttttggtggagaatgtcataggagaaatctggtccgagctggaggaaggtgataagtatgtggttgtggacagtggcggtggcaccgtagacctgacagtccatcagatccggttaccggagggacaccttaaggaactgtataaagcaacaggcggaccctatggatctttaggagtagattatgagttcgaaaaacttctgtataaaatatttggagaggattttattgaacaattcaaaatcaaacgccctgcagcctgggttgacttaatgattgcgtttgagtctcgcaaaagggcggctgccccagacagaactaacccgctgaacatcaccctgcccttctccttcattgactactacaagaagttccgcgggcacagtgtggagcacgccttgcggaaaagcaatgtggattttgtgaagtggtcctcgcaggggatgctgcggatgagtccagatgccatgaacgccctttttaagccgaccatcgatagcatcattgagcatctccgggacctgtttcagaagcccgaggtgtccaccgtcaagttcctctttctggtgggcggctttgccgaggcgcccctgctgcagcaggcggtgcaggctgcttttggggaccagtgccggatcatcatcccccaggacgtgggcctcaccatcctcaagggtgccgtcctctttggcctggaccccgcggtcatcaaggtgcgccggtcgccgctcacctacggggtaggcgtgctgaaccgctacgtggagggcaagcacccgcctgagaagctgctggtgaaggatggcactcggtggtgcaccgacgtctttgacaagttcatctctgccgaccagtctgtggctctgggtgagctggtcaagcgtagctacaccccggccaagccctcccagctggtcattgtcatcaacatctacagctctgagcacgacaacgtcagcttcatcactgatcccggggtgaagaagtgtggcacgctccgcctggatctcacagggaccagtggcactgcggtgcccgcccggagggagatccagacccttatgcagttcggggacaccgagatcaaagccacagccattgatatagccacttcgaagagtgtcaaagttgggatcgacttcttaaattactaaccctcccgccccgctgcctgtccccttggactcaacttatctgcatctgctgacctcaaccttgactgttctttccctaaccttgaccctcaccattgcccatgtgaatttcagcagggaagatgagaacaatcagggctagaaataattagtgacttttgagggcacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatacttgatgtattaagtcagttttttttcacagcgggcctgtggctcgcctgcatcagaattgcctgggtgcgtgttcagaacaggttcctggatctgagccctttttaactgaggccgactcttggagaggggcaccagaatctgcatttgtagtgtataccacatcgtggttcaactgaaattggagaaatactaacctgagattttgttgaagttcacacacagatcacagcccgccctctgcaggtgtcccctttgggctcctttaggaagagggcttccatgagaaggtgaccccataccttgccctcttggtcaatgggattggggctccacctggcttggagatggcccttttaaccctcacaggaagggccaggggaggaaaaaaattgcaagaaagcgacaccaagaacggagctgactgaggaaccaactggagggtcttcactctctccttccccagtgtacaaaaccagttttctgcaacattcaggagccaaatgaggaaaaagaatcaagaatctgactcacagcccatctgatctgttcaaagctgtcttttccacctgctgaaattcattaaatcactggaggcatgcataatgaatggagaatgagtgaacttccaatgcaacttggattcacaaacccattatcatagccaatatgcagattttaaacagcatttcacatttcatttgaccatgtcttctttttcgcatcgcctgctgcagaattccctactagaatgtgaaacaacgaacaaaccacagaacttagagtgtgctggttagtcacataacttagtagcaggattgtgtatccaggcacaaaggtgtctttgctaatgttctcttgctacctgccctgcttcaaacgctaaatggtatgggtctttctttgttgccagccatattctacaaataagacttttcaatatagttatgagtaatataattttatgtacatataatgttagaatattgtacagaatcttggtttctacgatgcgcttttcttgtttcaaaaagaggaaaatgcttgatttttgttgatgatacttttgttactgtccttaattttccatagtttggtttcttaattgtgctcactaagcatcgatctgtgctgatgccaagctatggactatgtacgcaagaccgagcaatagacagaggtgcctagggtccaaacacactgaacgcacgtggaccgcctggatcaggagcctcatcagacccttctccatgcacatccttcccaaacagtcacagattccattgaaaggagcagattctatcagttcttctgtgcagactttaagagctgaacgttctggttctggaagccatgtgactgcgcagaacaacctaagaaaccctttgtgtcctgaggggtcgttgacctctccttccgggtcggagcagtcactctgagggcaaagcgtggtccactgtgtgtgatgttttcaggatgctagggtcaaagaaagaaaccaagtggtacataagcccagcttttctgctgggctaagtgtaagtgtgagtaacatggtcaagcccctcttttttgggctaatgtaaagcctttcctgccttgcattaatgctatctccctgtgtactgtttctcttaaatgagcagatagaaatctgcagtgttggcagataggtgatggagaggatgataattttatcttctggccacagagctgcagccccagttgtcagagtccttaaatgaaacccccaaatccatccctccttccctacccccactggaatattctagaataagagcactggataagtacacttgaacacatttttctaaccttagaaaatacctacaaggcctgttgtcttgacccattactcaattgtccctggcatattatctgatcttcacgtttcttggaagcagaatcatcaaggctttcctttgtaactgccctttccgtacacagcaggcatgaataaatgctgagtaacagacaagttacagacaggaggggaaagaggaggaaccatacaactgtttttgcaaaatgatggctgagtccagattatagaggttgccttacccttagaatgttatttagaccaagtttagcttttagagtccaggtctggttaattgccagggtagcaaagaatcgcatgcaccaatgtaaacaggagtcagaatgcattattagtcaaagatcgaatttcacattgtagagatgtatagctgtgattaagctgcatatgtatgctgggaaacggcttgagtggatggctaatataaaagttgttggccataatgccacacctctcatctgcttgaaatatggaccagtattctaaaatatcagctactggggtctcattcactacaagataaattcaaacttcacagaactttgcagcagttcaccaccagacgggactgtgtctgcaaactctcttgtcttcacagacgcctaataaagcaaaactctga

SEQ ID NO: 12010 - DNA, 5922 bp, Homo sapiens
atgaggccccagaataggctgaagccaagttgtagcaaacgccaaggtgttcatcctgtgatcaaagaggagctgcttaaggtcggtgagctgagctgagggcattaagatggagagtgttggcgtgtacggattctgtgggtgtaaagcaaagaacaaaatgaagtgtgattcaaggtgggaaatagccgcttcaggaagtccaggtcgtcctgctggagaggccacctagaggggaactgaggcccccgaccgacagcctaggtgaacatggacatgaatgagcctgtcttggcccatctaatgccagatgagccttgagatgactttagctgcatgagttgaccccagaaacggctcccacatctgcatattcatctccagcccggagtcttggggacacaggaataacgcctctgtccccctcccatattgtgaacgacactgactccaacgtctcagaacagcagtcatttctcgtggtggtggccgtcgactttgggaccacatccagtggctatgcctacagcttcaccaaggagccggaatgcatccatgtgatgaggcgatgggagggaggtgaccctggtgtgtccaatcagaagactccaaccaccatcttgctgactcccgagaggaagttccacagcttcgggtatgccgccagggacttttaccatgacctggatcccaatgaggccaagcagtggctgtacctggagaagttcaagatgaagctgcacaccactggggacctcaccatggatacagacctgacggcagcaaatggcaagaaagtcaaagcccttgaaatctttgcttatgccctgcagtactttaaggagcaggcgctgaaggagctgagtgaccaggcgggttcggagttcgagaactctgatgtcagatgggtcatcacggtgcctgccatctggaagcagccggccaagcagttcatgagacaagctgcctaccaggcaggcctggcctcccccgagaactcggagcagctcatcattgccttggagcctgaggcagcctctatctactgccgaaagctgcggctacaccagatgattgagctgagcagcaaggcagccgtcaatgggtacagcggcagtgacacagtaggagctgggtttacacaggctaaggaacacatacggcgtaatcggcagagtcggacctttttggtggagaatgtcataggagaaatctggtccgagctggaggaaggtgataagtatgtggttgtggacagtggcggtggcaccgtagacctgacagtccatcagatccggttaccggagggacaccttaaggaactgtataaagcaacaggcggaccctatggatctttaggagtagattatgagttcgaaaaacttctgtataaaatatttggagaggattttattgaacaattcaaaatcaaacgccctgcagcctgggttgacttaatgattgcgtttgagtctcgcaaaagggcggctgccccagacagaactaacccgctgaacatcaccctgcccttctccttcattgactactacaagaagttccgcgggcacagtgtggagcacgccttgcggaaaagcaatgtggattttgtgaagtggtcctcgcaggggatgctgcggatgagtccagatgccatgaacgccctttttaagccgaccatcgatagcatcattgagcatctccgggacctgtttcagaagcccgaggtgtccaccgtcaagttcctctttctggtgggcggctttgccgaggcgcccctgctgcagcaggcggtgcaggctgcttttggggaccagtgccggatcatcatcccccaggacgtgggcctcaccatcctcaagggtgccgtcctctttggcctggaccccgcggtcatcaaggtgcgccggtcgccgctcacctacggggtaggcgtgctgaaccgctacgtggagggcaagcacccgcctgagaagctgctggtgaaggatggcactcggtggtgcaccgacgtctttgacaagttcatctctgccgaccagtctgtggctctgggtgagctggtcaagcgtagctacaccccggccaagccctcccagctggtcattgtcatcaacatctacagctctgagcacgacaacgtcagcttcatcactgatcccggggtgaagaagtgtggcacgctccgcctggatctcacagggaccagtggcactgcggtgcccgcccggagggagatccagacccttatgcagttcggggacaccgagatcaaagccacagccattgatatagccacttcgaagagtgtcaaagttgggatcgacttcttaaattactaaccctcccgccccgctgcctgtccccttggactcaacttatctgcatctgctgacctcaaccttgactgttctttccctaaccttgaccctcaccattgcccatgtgaatttcagcagggaagatgagaacaatcagggctagaaataattagtgacttttgagggcacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatacttgatgtattaagtcagttttttttcacagcgggcctgtggctcgcctgcatcagaattgcctgggtgcgtgttcagaacaggttcctggatctgagccctttttaactgaggccgactcttggagaggggcaccagaatctgcatttgtagtgtataccacatcgtggttcaactgaaattggagaaatactaacctgagattttgttgaagttcacacacagatcacagcccgccctctgcaggtgtcccctttgggctcctttaggaagagggcttccatgagaaggtgaccccataccttgccctcttggtcaatgggattggggctccacctggcttggagatggcccttttaaccctcacaggaagggccaggggaggaaaaaaattgcaagaaagcgacaccaagaacggagctgactgaggaaccaactggagggtcttcactctctccttccccagtgtacaaaaccagttttctgcaacattcaggagccaaatgaggaaaaagaatcaagaatctgactcacagcccatctgatctgttcaaagctgtcttttccacctgctgaaattcattaaatcactggaggcatgcataatgaatggagaatgagtgaacttccaatgcaacttggattcacaaacccattatcatagccaatatgcagattttaaacagcatttcacatttcatttgaccatgtcttctttttcgcatcgcctgctgcagaattccctactagaatgtgaaacaacgaacaaaccacagaacttagagtgtgctggttagtcacataacttagtagcaggattgtgtatccaggcacaaaggtgtctttgctaatgttctcttgctacctgccctgcttcaaacgctaaatggtatgggtctttctttgttgccagccatattctacaaataagacttttcaatatagttatgagtaatataattttatgtacatataatgttagaatattgtacagaatcttggtttctacgatgcgcttttcttgtttcaaaaagaggaaaatgcttgatttttgttgatgatacttttgttactgtccttaattttccatagtttggtttcttaattgtgctcactaagcatcgatctgtgctgatgccaagctatggactatgtacgcaagaccgagcaatagacagaggtgcctagggtccaaacacactgaacgcacgtggaccgcctggatcaggagcctcatcagacccttctccatgcacatccttcccaaacagtcacagattccattgaaaggagcagattctatcagttcttctgtgcagactttaagagctgaacgttctggttctggaagccatgtgactgcgcagaacaacctaagaaaccctttgtgtcctgaggggtcgttgacctctccttccgggtcggagcagtcactctgagggcaaagcgtggtccactgtgtgtgatgttttcaggatgctagggtcaaagaaagaaaccaagtggtacataagcccagcttttctgctgggctaagtgtaagtgtgagtaacatggtcaagcccctcttttttgggctaatgtaaagcctttcctgccttgcattaatgctatctccctgtgtactgtttctcttaaatgagcagatagaaatctgcagtgttggcagataggtgatggagaggatgataattttatcttctggccacagagctgcagccccagttgtcagagtccttaaatgaaacccccaaatccatccctccttccctacccccactggaatattctagaataagagcactggataagtacacttgaacacatttttctaaccttagaaaatacctacaaggcctgttgtcttgacccattactcaattgtccctggcatattatctgatcttcacgtttcttggaagcagaatcatcaaggctttcctttgtaactgccctttccgtacacagcaggcatgaataaatgctgagtaacagacaagttacagacaggaggggaaagaggaggaaccatacaactgtttttgcaaaatgatggctgagtccagattatagaggttgccttacccttagaatgttatttagaccaagtttagcttttagagtccaggtctggttaattgccagggtagcaaagaatcgcatgcaccaatgtaaacaggagtcagaatgcattattagtcaaagatcgaatttcacattgtagagatgtatagctgtgattaagctgcatatgtatgctgggaaacggcttgagtggatggctaatataaaagttgttggccataatgccacacctctcatctgcttgaaatatggaccagtattctaaaatatcagctactggggtctcattcactacaagataaattcaaacttcacagaactttgcagcagttcaccaccagacgggactgtgtctgcaaactctcttgtcttcacagacgcctaataaagcaaaactctga

SEQ ID NO: 12011 - DNA, 2383 bp, Homo sapiens
gctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaa

SEQ ID NO: 12012 - DNA, 3242 bp, Homo sapiens
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagaaaaaaaaaaaaaaa

SEQ ID NO: 12013 - DNA, 3159 bp, Homo sapiens
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagaaaaaaaaaaaaaaa

SEQ ID NO: 12014 - DNA, 3997 bp, Homo sapiens
gtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggagggacctaccagggccagtgggtcggtggcatgcgccagggctacggcgtccggcagagcgtcccgtatggcatggccgcggtcatccgctcacccctgaggacgtccatcaactccctgcgcagcgagcacaccaacggcacggcgctgcatcccgacgcctctccggcggtggccggcagcccggccgtgtcccgcgggggcttcgtgctcgtggcccacagtgactccgagatcctcaagagcaagaagaaggggctgtttcggcgctcgctgctgagtgggctgaagctgcgcaagtcggagtccaagagcagcctggccagccaacgcagcaagcagagctcctttcgcagcgaggcgggcatgagcaccgtcagctccacggccagcgacatccactccaccatcagcctgggcgaggctgaggccgagctggcggtcatcgaggacgacatcgacgccaccaccaccgagacctacgtgggcgagtggaagaacgacaaacgctccggcttcggcgtgagccagcgctcggacgggctcaagtacgagggcgagtgggccagcaaccggcgccatggctacggctgcatgaccttcccggacggcaccaaggaggagggcaagtacaagcagaacatcctcgtcggcggcaagcgcaagaacctcatccccctgcgggccagcaagatccgcgagaaggtggaccgcgccgttgaggccgctgagcgggccgccaccatcgccaagcagaaggctgagatcgcggcttccaggacctcccactctcgggcaaaggccgaggcagccctcacagcagctcagaaagcccaggaggaggcgcggatcgccaggatcactgccaaagagttctccccttccttccagcaccgggaaaacgggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacgggctcagcgcctatcctggtggtcatggtgatcttgctcaacatcggagtcgccattctgtttattaactttttcatctgatgagatgtcgcggtagcaaaaatagagaaagggtagaaaaaagggacattaaaattaaaagcaaaaccacaagaagggaaagaccgcaactcggacagcccagcgacttccaagtcctctcacagaagaaccacacgattgggtatcactcacagtttgcctttttttctgggtaatgttttttggattttagccaaaattctttgcttgtataacactctgctgtgtggcatggcagaaggaggccagcacgcagcccctccagctccacgtggagacagaagggatcccggcacatcagtggtaacagcggacgttgtcctcgtggtcacacgtcccgtcttgggtgtggatggagggcagcccggggcagagcctcagccccgcggcccctgagtggcagggctgactcccgtcgacacgagcttagaaagtggattcactgctttctctgtctagaacagacgggtgacaagtatgggcaggaggcatggggcagggtggcccaccccagtgggcagtagcctggcctttttctgtgtgagatctgtgctgcacacctgagggagggggagggatcggccacctcctccctgtgagacggatgcaggtccttccctcttctcggcactgcccccggccttccatgagaagccgactccccacaccgagttttaaagcaaagcccttttcttctgctgcccactcactgtgggtcccattcggctgtttcccccaccagaccccagggaagccggggcccactccgatccgcctgggctcagctaagcacggaagccaagggggctgtgccgtggagctgggctcgcgccggggctctgggtgtgtgcgcttggcgtgcagggtggacgcgtggggttccgtgtccccagcagtgagggccctagaggacgccttctcccatggttactgatctccacgggttttcacatctctgtactgtgcctgcctcaacttcccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccaccagggtcgctccatcacccaaacaaaagaacaaggtttgccaggatgtccgagtgccccctggccctggctctcgtgtgcatggacgtgcctgaggggtccgggcacggccatacgcaggacccctgtgcccggggaggcgctgcagggattccccatccggtcgtcttggggccagcccgtcttatggactctgccttgctttgcttatgtttagctgtttctctgctacctttcgagcagacttctttactacactgcactggattgctatatttttaaccagaaataaactaaagattagagcatgttccagttaaa

SEQ ID NO: 12015 - DNA, 1757 bp, Homo sapiens
gcacgagccaccacctgcctcaccagtagctgggactacagctcccgtcactagctttttctcctcaagcctgcactgcacaccaactgggacggagggtgcagatgaataaaggcaaatccatcaccaaaagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaaaaaaaaaaacacgggtgacagccgcagttggtgctgtgaaagtggcgagaagtgtcctgggcctcccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaaa

SEQ ID NO: 12016 - DNA, 1936 bp, Homo sapiens
gccagtaacaaacatggctccctgaagccgctcaggctcaagagcaacatggaggtctgcacttaatcgctcctctccgggggcggccatactgaggaggcatctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcgggtacaaaaaccagaggccggggaaggcgccggtgggaggcaaggcacggatggactttacctgcgcacgcgtcgcagccatctccgcgcacagtggtggccaccgcgactggtgctgaagtgtcggcgtgtgccgggcgctccgctgggacccgggttgctcgccctgagtctcagctttctcatctgtacggttgggacaagtacagtaaccctcgcccgtcaagacgggccagggctgtggcgagggtccacgccttagagcaggcacctatcttgtgcagggccctgagatggggtctgactcagttcctgcggggaacttcaccagtgacccagtcagtgcccttcagttaaagaccaccaggagcacacttatatcatggaaatcaggacagtggcagttcggattgtggcaatcaaaggggtggaaagtgaattctatcttgcaatgaacgaggaaggaaaactctatgcaaagaaagaatgcaatgaagattgtaacttcaaagaactaattctggaaaaccattacaacacatatgcagcagctaaatggacacacaatggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttttagtaatcaagaaaggctggaaaactactgaaaaactgatcaagcttgacttgtgcatttatgtttgttttaagacactgcattaaagaaagatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtgtatcagacctacaggctgctggcaggatttgtcagataatcaagccacactaactatagaaaatgagcagcattttaaatgctttctagtgaaaaattataatctacttaaactctaatcagaaaaaaagaatattctcaaaaaaatctattacgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacaaaataacattttataatttctcaaagtaaaattgagaaatctttaagtttttttcaagtaacataatctatctttgtataattcgtatttgggaatatggcttttaataatgttcttcccacaaataatcatgcttttttcctatggttacagcattaaactatattttaagttgtttttgaaaaaaaaaaaaaaaaaaaaaaaaaaaaaaaaaaaaaaaaaaaaaaaa

SEQ ID NO: 12017 - DNA, 3665 bp, Homo sapiens
ctcttccgtgcaggcaggctctcctggggacctcagagattctctccagcggcagcagaaaacgggcaatgggtggattcgggtccagattctggcaggagggagtttgggatcgagatctggaaaaaagcactagactggaagaggacgcgatggagtcggagccgctggcggggacaaaaaccagaggccggggaaggcgccggtgggaggcaaggcgcgcatagactttacctgcgcacgcgtcgcagccatctccgcgcacagtggtggccaccgcgactggtgctgaagtgtcggcgcgtgccgggcgctccgctgggacccgggttgctcgccctgagtctcagctttctcatctgtacggttgggacaagtacagtaaccctcgcccgtcaagacgggccaggctgtggcgagggtccacgccttagagcaggcacctatcttgtgcagggccctgagacggggtctgactcagttcctgcggggaacttcaccagtgacccagtcagtgcccttcagttaaagaccaccaggagcacacttatatcatggaaatcaggacagtagcagttgggattgtggcaatcaaaggggtggaaagtgaattctatcttgcaacgaacgaggaaggaaaactctatgcaaagaaggaatacaatgaagattgtaacttcaaagatctaattctggaaaaccattacaacacatatgcagcagctaaatggacaaacaacggaggggaaatgtttgtggccttaaatcaaaaggggattcctgtaagaggaaaaaaaacaaagaaagaacaaaaaacagcccactttcttcctatggcaataacttaattgcatatggtatataaagaaccagttccagcagggagatttctttaagtggactgttttctttcttctcaaaattttctttccttttattttctagtaatcaagaaaggctggaaaactactgaaaaactgatcaagctggacttgtgcatttatgtttgttttaaggcactgcattaaagagacatttgaaaagtatacacaaaaatcagatttagtaactaaaggttgtacaaaattttaaaactggttgtacaatcatgatgttagtaatagtaattttgttcttaaattaatttacccttaagagtatgttagatttgattatctgataatgattatttaaatattcctatctgcttataaaatggctgctataataataataatgcagatgatgttatataaggtatatcagacctacaggctgctggcaggatttgtcagataatcaacccacactaactatggaaaatgagcagcattttaaatgctttctagtgaaaaattataatctacttaaactctaatcagaaaaaaagaatattctcaaaaaaatctattatgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccactaaataacattttataattcctcaaagtaaaattgagaaatctttaagtttttttcaagtaacataatctatctttgtataattcatatttgggaatatggcttttaataatgttcttcccacaaataatcacgcttttttcctatggttactgcattaaactctatattaagttgtttttgaacttattgttttgttatttaagtttatgttatttataaaaaaaaccttaataagctgtatctgtttcatatgcttttaattttaaaggaataacaaaactgtctggctcaactgcaagtttccctcccctttgtgactgacactaagctagcacacagcacttgggccagcaaatcctggaaggcagacaaaaatgagggcctgaagcaatgcttacaatagatgtctcacacagaacaatacaaacatgtaaaaaatctttcaccacatattcttgccaattaattggatcatataagtaaaatcattacaaatataagtatttacaggattttaaagttagaatatatttgaatgcatgggtagaaaagtatcatattttaaaactatgtatatttaaatttagtaattttctaatctctagaaatctctcctgttcaaaagatggcagcactgaaagttgttttcctgttagatggcaagagcacaatgcccaaaatagaagatacagttaggaataaggggccctgaatgttatgaaggtttgaagtcagcctacagataacaggattattacaaagatgaatttccacttccaaagtctgtcattggcagatcttggtagcactttatatgtttaccaatgggaggtcaacatctatctaatttaaaagctatgctaaccattgtggttttaatttcaaaatatttgtcatacaagtccctttacataaatagtatttggtaatacatttatagatgagagttatatgaaaaggctaggtcaccaaaacaatagattcatttaattttcctgtggttgacctatacgaccaggatgtagaaaactagaaagaactgcccttcctcagatatactcttgggagagagcacaaatggtattctgaactatcacctgattcaaggactttgctagctaggttttgaggtcaggcttcagtaactgtagtcttgtgagcatattgagggcagaggaggacttagttttttgtatgtgtttccttagtgcctagcagactatctgttcataatcagttttcagtgtgaattcattgaatgtttatagacaaaagaaaatacataataaaactaatcttcattttaaaagggtaaaacatgactacacagaaatttaaatagaaatagtgtatatacatataaaatacaagctatgttaggaccaaatctctttgtctatggagttatacttccatcaaattacatagcaatgctgaattaggcaaaaccaatatttagtggtaaatccattcctggtagtataagtcacctaaaaaagatttctagaaatatgtactttaattatttgtttttctcctatttttaaatttattatgcaaattttagaaaataaaatttgctctagttacacacacttagaattctagaatcttaaaactgtaaggggcctccatcccttttactcatttgtagtctaggaaatcaagattttgatacacctcaggtcatgcagctgggtagatatacaactgtcacaagagtctagatcagttggcacatgctttctatactagattattagtattattagctaatggtcttctgcattttttggtttttgatttgtattgagatatagcctttacatttctacacaaatgtgactatgtattggcaatgcacttcatacacaatgactaatctatactgtgatgatttgactcaaaaggagaaaagaaattacgtagttttcaattctgattcctattcaccttttgtttatgaatggaaagctttgtgcaaaatatacatataagcagagtaagccttttaaaaaattttctttgaaagataaaatacatgagtttctaacaattaga

SEQ ID NO: 12018 - DNA, 4084 bp, Homo sapiens
atgcagaaatttctagaaaagggtggtaacttctgggtgactgccatggaaacgggtgtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgtgccctacgcgctggtactggaagctggttcctcacgcaattgccttctgtttgaaggagtcggggagcaaaccccccatgatccgataccgcaaggaccgtgtggtggcgcgacgtgccccctgcttcccgacggtgaccagcctccaggacctggccagtggggccgcgctggccgccaccatccactgctattgtccccagctgcttcgacttgaggaggtgtgcttgaaggaccccatgtctgtggcggacagcctgtacaacctccagctcgtgcaggatttctgtgcctctcgccttcctcgtggctgccccctgtcccttgaggacttgctgtacgtcccaccgccactcaaggtcaacttggtggtgatgctggccgagttgttcatgtgttttgaggtgctcaagcccgactttgtgcaagtgaaggacttgcccgatggtcacgctgcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 12019 - DNA, 4084 bp, Homo sapiens; identical to SEQ ID NO: 12018

SEQ ID NO: 12020 - DNA, 6500 bp, Homo sapiens
tatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactctgcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatatagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccggatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtttcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagcccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtaccttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcctaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttgaaaaaaaaaaaaaaaaaaa

SEQ ID NO: 12021 - DNA, 6584 bp, Homo sapiens
tatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactctgcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccggatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatcagattaccagacatcacaccaaaccattgaaggaagaaagaggggctattgatcagcatcaagaaactaaacaaacaaccaaggaccaatctggagagtctgatacacagaacatggtttctgaagagccctgtgaacttccctgttggaatcattcagacccagaaagcatgagcttattcgacgaatattttaatgatgattcaatcgaaaccaggactattgatgatgttccatttaaaacaagtacagatagtaaagaccattgctgtatgttagagttttcaaaaatattgtgtacaaaaaataacaagcagaacaatgaattttgtaaatgtatagaaacagttccccaagattcatgtaaaacctgctttcctcagcaggaccaaagagatacactctccattcttgtcccccatggggataaagagagttcagataaaaaaattgctgtaggaactgaatgggacattccaagaaatgaaagttcagacagtgcccttggggatagtgaaagtgaagatacaggtcatgatatgactagacaagttagcagttattatggaggagagcaagaagattgggcagaagaggatgagataccttttcctgggtcaaagttaatcgaagtgagtgctgttcagcccaacattgccaacttcgggaggtccttgctgggtggctactgctcatcttatgtgcctgactttgttcttcaaggaattgggagtgatgagaggttccgtcagtgtctgatgtcagatttatctcatgctgtgcagcatccagttttggatgaaccaatagcagaagctgtctgtattatagctgacatggataaatggactgttcaagtggccagtagccagagacgagtgacagataataaattgggaaaggaagtattggtttccagtcttgtttccaatctgcttcattccacacttcagctttataagcataacttgtctccaaatttttgtgtaatgcatcttgaagaccggttgcaggagctatacttcaaaagtaaaatgctgtctgaatacctgagggggcagatgcgtgttcatgtcaaggagctgggagtggttctggggattgaatccagtgatcttccacttctggctgctgtagcaagcactcactctccatatgttgcacaaatactcctttaatatacctaaaaattgttagaaattggtgggaaaataggtagaaaccaaggaagcagacacaacatgcatttatggagattctttttcccttttagacttccatctgaatgagtcagtcaccagggtattctgcatagcattgtatattctgtgtatgtcagatggctttttctttttgactggacttttgggtggtggtagatttttaaacaaatgaaattaaagcaacaataattttgaagcatttgaaaaagccaaagtgtacggtagaaatttctacaaaatgaatattatcaagagtttcatgtgatcactgcagtgttgtcacagctcataaatagcaacagtgtttcatgatttaatggctcagaaatagttattcattagtttttaatttttaatttctaaggtacagagatctataaaaccttgattatttgttagttttgcaattcaaaacagctaatgtctggttatttctcaaagtaagtattttaaacagcctgttaattataagaaactcagaataatgagtgtaaatgtgttatgttatccacccaagtgtacatatgtacctatttttttttaaaaagcagaaatagaaatacaagactggtaaacatgcctttaaaaatatatatattttcaactagtattgtctataatgctgaaatattacttattggtgatttttctgtttcacacactctaaaatataagtaaagccaaccttttttttaaggctgagattcccaaaatgagaatactactttataccatttgtttataagtatgaactgttcttataaatattaatatttacatattcactaatttaacataaatgaaaattaggattaaaaattgcaccaaagcatcggcaaaaacaatactatattctttaaaagtgctcaggtagccaaggcccttgcttttggtatcaaccctcatgaacccataggagctgaatatttgtttcactgcttaataatcctcaatttacactattcataactcttaaaattattctctttttttctaagagcccctcccttccaaaagtgtatttttttcaaagattttcacttctcaattgttgcctttgtacatactatagagtgttgcttgtaagaaaggctaatatggaaccaaactcttgtaagtaatgtaaatagaaaggtgggtggataaagttttcaatactttctactacctcagtttacttgagtactacattatagtttattctttgcttatctggtctaagagacttttaatgctagtagtaaagttggtttctgctttcattgactattttcatcataatttcatcattgattaaaaaaagaaaaccacttgtttattcagttattaaatatatttactatataacacatccattcttgctgtttaaattttcaatagttaatggaaagttgtctttgaccttgaatttacagcattgggtcacattttgccttgctgtgtatgtattcaagagacttccaactagacaaagaaaaaattgttgttttaatggaatgtaaacctgaaattggtgtgtctgcaatctgtttggcccatgaccttttacctagtcccagttattacctgagtctcccatggatgacttgctgccaaggagtgtttgtggatatattttctttggcttaattttcttattctgtgcattaacaaaattatccagttgtctgattttggaattctatgagtcaatctttttggcagaattcagaatattaaaaagttcatacatttgcgggccattgtaccttttttttttttttttttttttgacggagtttcactcttgttacccaggctggagtgcaatggtgcgatctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctcatgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcctaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttgaaaaaaaaaaaaaaaaaaa

SEQ ID NO: 12022 - DNA, 2917 bp, Homo sapiens
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccgcccttccgcctaggaaacccagaagaaggtcaaagaatgcgactatcctccgctccctcacaggcccaggacttcagcattttggggaaaagatccagtttgctccacaagaaaataggaatgaaagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgacttccagcatgaacggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactgggagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacacc

SEQ ID NO: 12023 - DNA, 5312 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 12024 - DNA, 5436 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 12025 - DNA, 1868 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgttttcaatgtataaggactatagtgatttaaactcatcaatgtgcctttgcataaagttgattaaataaatattgatgtggtataaatgcccatcagatatgct

SEQ ID NO: 12026 - DNA, 4006 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttgaacaacatgttctaccgtggatttgtacttgctccttttgctctttttgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcatggtggtgggcgcctgtaatcccagttactcgggaggctgaggcaggagaatcacttgaacccgggaggcagaggttgcggtgagccaagagcgcaccattgcactccagccttgggcgacaaaaacgaaactccatcttcaaaacaaaacaaaacaaaacaaacaaacaaacaaaacttgcatcttaaccaaaagtcttggttttatcttaatccattaaaagttggtcttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatatgcacacatatataggcagttgcatgcctagcatgggtattttataaccatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaatgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattctt

SEQ ID NO: 12027 - DNA, 2368 bp, Homo sapiens
gtttctctccctgcccccgcgacttcgcgcaagatccgggaaggacacccgaggcccctgggagaccctggggaggtgaaagtcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtaaaaaaaaaaaa

SEQ ID NO: 12028 - DNA, 3450 bp, Homo sapiens
gtagaacagtggggagctgtgcggatgggtgaagtgcatgtatgcctgcctagacgggccagaaaagccaaacttaagaaatctgcctatgtacagaacaagtcaactaaggggttctcattaatctaccgtctgtgaatatcgttatttttcaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 12029 - DNA, 3727 bp, Homo sapiens
gcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 12030 - DNA, 4222 bp, Homo sapiens
gagccagcggctcttgggaggctgcgtccgcgcgccggcggggcggggcggccgggccctgcgcgtcaggcctgagacctgggaggaagctggagaaaagatgccctctgaatctttgtgtttggctgcccaggctcgcctcgactccaaatggttgaaaacagatatacagcttgcattcacaagagatgggctctgtggtctgtggaatgaaatggttaaagatggagaaattgtatacactggaacagaatcaacccagaacggatagctccctcctggaaaagcttttgtctggtcctctgagccccagtgagagtttcctgaggtacctcacccttccacaagacaacaggcttgccattgatctgcaacaaacggcggttgttgtcatggcccatttagaccgtctggctacaccctgtagatgcctcctctgtgtagctctccgacgtctcataagagtcattttttacaggtcagaactgtagaaataatgagaaagtgacacttgtacgcatagctgatttggagaaccataataacgatggaggcttctggactgtgattgacgggaaagtgtatgatataaaggacttccagacacagtcgttaacagaaaatagtattcttgctcagtttgcaggggaagacccagtggtagctttggaagctgctttgcagtttgaagacacccgggaatccatgcacgcattttgtgttggccagtatttggagcctgaccaagaaggcgtcaccataccagatctggggagtctctcctcacctctgatagacacagagaggaatctgggcctgcttctcggattacacgcttcctatttagcaatgagcacaccgctgtctcctgtcgagattgaatgtgccaaatggcttcagtcatccatcttctctggaggcctgcagaccagccagatccactacagctacaacgaggagaaagacgaggaccactgcagctccccagggggcacacctgccagcaaatctcgactctgctcccacagacgggccctgggggaccattcccaggcatttctgcaagccattgcagacaacaacattcaggatcacaacgtgaaggactttttgtgtcaaatagaaaggtactgtaggcagtgccatttgaccacaccgatcatgtttccccccgagcatcccgtggaagaggtcggtcgcttgctgttatgttgcctcttaaaacatgaagatttaggtcatgtggcattatctttagttcatgcaggtgcacttggtattgagcaagtaaagcacagaacgttgcctaagtcagtggtggatgtttgtagagttgtctaccaagcaaaatgttcgctcattaagactcatcaagaacagggccgttcttacaaggaggtctgcgctcctgtcatcgaacgtttgagattcctctttaatgaattgagacctgctgtttgtaatgacctctctataatgtctaagtttaaattgttaagttctttgccccattggaggaggatagctcagaagataattcgagaaccaaggaaaaagagagttcctaagaagccagaatctacggatgatgaagaaaaaattggaaacgaagagagtgatttagaagaagcttgcattttgcctcatagtccaataaatgtggacaagagacccattgcaattaaatcacccaaggacaaatggcagccgctgttgagtactgttacaggtgttcacaaatacaagtggttgaagcagaatgtgcagggtctttatccgcagtctccactcctcagtacaattgctgaatttgcccttaaagaagagccagtggatgtggaaaagagaaagtgcctactaaaacagttggagagagcagaggttcgcctggaagggatagatacaattttaaaattgtatctggtgagcaagaatttcttacttccatctgtgccgtatgcgatgttttgtggatggcaaagacttattcctgagggaatcgatataggggaacctcttactgattgtttaaaggatgttgatttgatcccgccttttaatcggatgctgctggaagtcacctttggcaagctgtacgcttgggctgttcagaacattcgaaatgttttggtggatgccagtgccaaatttaaagagcttggtatccagccggttcccctgcaaaccatcaccaatgagaacccatcgggaccgagcttggggaccatcccgcaagcccacttcctcctggtgatgctcagcatgctcaccctgcagcacagcgcaaacaaccttgacctcctgctcaattccggcacgctggccctcgctcagacggcactgcgcctgattggccccagttgtgacagcgttgaggaagatatgaatgcttctgctcaaggtgcttctgccacagttttggaagaaacaaggaaggaaacggctcctgtgcagctccctgtttcagggccagaactggctgccatgatgaagattggaacaagggtcatgagaggtgtggactggaaatggggcgatcaggataggcctcctccaggcctaggccgagtgattggtgagctgggagaggacgggtggataagagtccagtgggacacaggcagcaccaactcctacaggatggggaaagaaggaaattacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcaaatgctggtgtacagggagcaacaccggagctggtgcacgctggggtttgtgcagagcatcgctctcacgctgcaggtgtgcggcaccctcagctccctgcagtggatcacgctgctcatgaaggtcgtggaagggcacgcacccttcactgccacctcgctgcagaggcagatcttagctgtgcatttgttgcaagcagtccttccgtcatgggacaagaccgaaagggcgagggacatgaaatgcctcatggagaagctgtttgacttcttggggagcttgctcactatgtgctcctctgacgtgccgttactcagagagtccacgctgaggcggcgcagggtgtgcccgcaggcctcgctgactgccacccacagcagcacactggcggaggaggtggtggcactgctgcacacgctgcactccctgactcagtggaatgggctcatcaacaagtacatcaactcccagctccgctccatcacccacagctttgcgggaaggccttccaaaggggcccagttagaggactacttccctgattccgagaaccctgaagtggggggcctcatggcggtcctggctgtggttggaggcatcgatggtcgcctgtgcctgggcggccaagttgtgcacgatgactttggagaagtcaccatgactcgcatcaccctgaagggcaaaatcaccgtgcagttctctgacatgcggacgtgtcacgtttgcccattgaatcagctgaaaccactccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggacaagtggacctggacctgctgcggtgccagcagttgaagctatacatcctgaaagcaggtcgggcgctgttctcccaccaggataaactgcggcagatcctgtctcagccagctgttcaggagactggaactgttcacacagatgatggagcagtggtatcacctgaccttggggacatgtctcctgaagggccgcagccccccatgatcctcttgcagcagctgctggcctcggccacccagccgtctcctgtgaaggccatatttgataaacaggaacttgaggaaagaatgtccagatgttgtttttggagaagaagaactacaaagttagagcaaatactcttatttataagaagaatgaactcagtgtgtgagaaggagaatacaaatgcaacagcctcaaattagcagtggatgcctactgggcttctgcaaccgctttccacgg

SEQ ID NO: 12031 - DNA, 1113 bp, Homo sapiens
gggggacccggcgccgatgaaaccgaccaaactggagttagctaccggactgtcccgcgagcgaaagttggaaataatacctaaacctacttcttgacatggtgtcaaaacagagcttttgctgagagtttgatttataaagaaattatggttcgactgaccttggatctaattgccagaaacagcaatcttaaaccccgaaaagaagaaaccatttcacagtgcctgaagaaaataactcatataaatttttcagacaaaaatatagatgcaattgaagacctctctctttgcaaaaatcttagtgttttatatttatatgataattgtattagtcaaatcactaacctgaattatgccacaaatctgacccacttgtacctacaaaacaattgtatttcatgtatagagaacctcaggtcattaaagaaactggaaaaactgtatctgggaggcaattacattgctgtcatagaaggtttagaaggattaggagaactaagagagcttcatgttgagaatcagaggcttccccttggggaaaagcttctgtttgatccaagaactcttcattctctggcaaaatccctctgtatattgaatatcagcaataataatattgatgacattacagacttagaactactagagaatcttaatcagctcatagccgttgacaaccaacttctgcatgtgaaggatttggagtttttactgaacaagttgatgaagctgtggaaaattgatctaaatggaaatcctgtttgtctcaaaccaaaatacagggacagactgatattggtgtccaaatcactgggtacatatttatattaatataatttttaagagaatgacacctagttaactttttggttattttaccagcaagctttcagaaatataaatctgacatctggatctgtgaaaattgtcaactttaaattcaatattttgaataagagcaaaagttaaaattgacaaataaagcatgaaaaacatctgctgttcagaagtaattaaagcacctgatacttattccttaaggaggatattttgctattaccaataaaaatggttagtcataaaaaaaaaaaaaaaaaaaaaaaaaaaaaa

SEQ ID NO: 12032 - DNA, 1834 bp, Homo sapiens
atgggaaacaagcagccccagaaggtcacggtgcctactgggacagccctccaaggagtggtattgatcgtctccacgctgcaccagccaggtggctggatatgtggcaaggatccctgctgcagcttgaggccactttcaaactctgtacagaacgccttggcctgcaagagtaaacaagattaccaggctggaattctgttcaagaccagggcttttatatccagagattgtgggtcagatgcggcagaagactctgcttccaagggagagacttatactttaaccttggagcataaggcctttggaggaaagaaaaatgttgaaagaggtgttgatatccgccaaggtccccgagggccacgtttgggcatcagcactctggggagccgggcgctcaggctcgccaggctgcaaagagagctgagagctgcctcgcgccccgcgcagaaccggcggtggaataaccagcgcctcaagtgtgtgcatctgggaccagggggcgggggagggggacctgcggccccgcggccaacccgagccgtgtgggcagccgcgggctatataagccgcgagcctggccgccgcggggcagacggcgacagcagcggcggcgagcgcctcggagcgcggcggaacagcgccccccgagccccgtgccccccgacgggtccgcccgcccgcccgccctcccgaggagcgccggcccgggcccgcgagggccgccgccaccccgcagcagatttggatcccccgcccggcgagcccccggctgctgcctcccggggggccccggcgcagcggccgccctcggagagccccggcgccccgccgcccggccccgcagacgccggaggcgccatggccgccaagcccggcgagctgatgggcatctgctccagttaccaggcggtgatgccgcacttcgtgtgcctggccgacgagttcccgcagcccgtgcggcccgccaagctgcccaagggccggggccggctgcggcggccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggggcgccgcccgcgggggggacgcgcgcgtccgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcac

SEQ ID NO: 12033 - DNA, 1752 bp, Homo sapiens
atgggaaacaagcagccccagaaggtcacggtgcctactgggacagccctccaaggagtggtattgatcgtctccgcgctgcaccagccaggtggctggatatgtggcaaggatccctgctgcagcttgaggccacttccaaactctgtacagaacgccttggcctgcaagagtaaacaagattaccaggctggaattctgttcaagaccagggcttttatatccagagattgtgggtcagatgcggcagaagactctgcttccaagggagagacttatactttaaccttggagcataagggggcgggggagggggacctgcggcccgcggccaacccggttggtgcagacttggggatcccagaagggacagtgcccgcccagtcgcggcgattgagggtccctgtccgggcgcaggctcgggccagccgcgtgctccggggccgcggcttctcccggaacccccgcggagccgtgtgggcagccgcgggctatataagccgcgagcctggccgccgcggggcagacggcgacagcagcgcggcgagccctcggagcgcggcggaacagcgccccccgagccccgtgcccccgacgagtccgcccgcccgcccgccctcccgaggagcgccggcccgggcccgcgaggccgccgccaccccgcagcagatttggatcccccgcccggcgagcccccggctgctgcctcccggggggccccggcgcagcggccgccctcggagagccccggcgccccgcgcccggccccgcagacgccggagcgccatggccgccaagcccggcgagctgatgggcatctgctccagttaccaggcggtgatgccgcacttcgtgtgcctggccgacgagttcccgcagcccgtgcgcccgccaagctgcccaagggccgggccggctgcggcgccgcgccagtctcgcttcaagacgcagccggtgaccttcgacgagatccaggaggtggaggaggagggggtgtcccccatggaggaggagaaggccaagaagtcgttcctgcagagcctggagtgcctgcgccgcagcacgcagagcctgtcgctgcagcgggagcagctcagcagctgcaaactgaggaacagcctggactccagcgactccgactcggccctgtaaggcgccgccgcgggggggacgcgcgcgtcgcggtccgcgcggggaccggcgtgtgaaccccgagagtgcccgcgccctgctcccgggggacccgcaaggacccgggaccgccgctcctcgcgcgctcggactcccgccccgctgcgaaccggtcggtgcgcccctcgccgcgctcgccctggcccgggagcgccgggagcggggccgctttcctcgtccttgtaaatgtttattttttaactcttcccagtgcgaactctgctgtgagtgtgtgcggggaggcgcgcccgcgctgagtcggcggcgggtagccactccatgcccttgtccgatggtttgcaactccgattttgcacaccgctccaccgtgccccccagcgcacacccattcacactcacgccaacactctcgctgaacacttttataattgttaggcgtggccgttgggactttgggcgcagcgcggctgctactgcgtctggaggattgatatttatttttgcattgcgatggctgaaggcatttatttaacgatctttttacctggatatgtctgtgaggctcctgaaaggagacaaataaagtcaatatatttgcac

SEQ ID NO: 12034 - DNA, 1471 bp, Homo sapiens
cctgcaagtggtgcgctggctgcagctgtggcaaccccagatcccgtcctcccgcctcgcacccatcagcgcggaccccgggggcgacgcagtggcgatgtcgggctgtgggcccagcggtggcactaggcggagaagcaccactcaaccccatccctgggctgcagagggcccagcgcggggggctccgagcgtcgggagcctgtggaagagaagagcgcgcgggcgacagttaaacaggccctggggcagggcgcgcctcgcgctccagggagccccgccctcccgcggcacctccgcagcaaccgccgcctgcactgggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcgaaggtccgtggacagactgctttgcctgttgttgctcttcggaggcggcgatccccgaaggcgagctgaaatacggctgcaggctacaatttgcagccgaccattatggatgacaaggagccgaagaggtggcccaccctcagggaccgcttgtgctcggatggcttcttatttccccaataccccattaaaccgtatcatctgaaggggatccacagagctgtcttctatcgtgatctggaggaactgaagttcgttctgctcacgcgttatgacatcaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcatatggtgcaaatattgaagaatgcagcgaggtataggtcaaccaatgttattttcaaactatctgaaatgcatttattttaacattgacacatgtaagggtcaatttttcatatttggaagctcaaacattccttgaatgaaaatattttgaaatgccttaactgtctaagattttactttaaattttggaacttttaaagaagcattataaggaacagctatttttcatgcacttatggtaaataattatacaaacatgaattacaataaatttggaattcatgacaactgaatttgggaaaggtaatagttaagtgtttttccactaaattactctttttctaatcagtgtgaagtgacacaggaaagtaaaattggcccttataaataggctttattttaaatttcaaagaaaattaaagaatttcacaataaatgtacatcttgttgc

SEQ ID NO: 12035 - DNA, 2018 bp, Homo sapiens
atgcaggcagcagcagccttgggaaccccgattgcccctcctcacacctgcccatcacaggacttgggcgacggggtggtgaagtcaggctgtggccccagcggcgccacgaggccgaaaaccggcgctcagcctcatcccggtggctgcggagtgccaagcgccaggtcctgcgctctgggcgtgggtcaggagcagctggcaagggcagcgcagcctatggggcctttgggcgcggccggccgcagctccgggaagccacgtcagcccacgggcgctgcagctgcagccgccaccagcacatggagcaggggtccccgaggattgggaatccccgaccaggcctgcgcctccagccgcgcggaccccggggccagcctggccgcggcaagtcaggcagtctgcggcaggagcgccgggcatgggcttcggccgggggtgcaggaggcgcgcaccctccggccggatggcggcgcactcagggctcaggaggccatcccacgggagccccgccagcccccgccggagcccgagctgcagtgccgcctgcaagtggtgcgctggctgcagctgtggcaaccccggataccgtcctcccgcctcgcacccatcagcgcggaccccgggggcgacgcagtggcgatgtcgggctgtgggcccagcggtggcactaggcggagaagcaccactcaaccccatccctgggctgcagagggcccagcgcggggggctccgagcgtcgggagcctgtggaagagaagagcgcgcgggcgacagttaaacaggccctggggcagggcgcgcctcgcgctccagggagccccgccctcccgcggcacctccgcagcaaccgccgcctgcaccgggcgcgcgagagctgctagggcggtttctctgcctcgggcctgttgggcagggccggctaaggtgcgcgtgctcgctggttctaacccttctgttgggcgtttctgcggagaggcgggaggcgctgagagtctgcgcggaggtccgtgcacagactgctttgcctgttgttgctcttcggaggcggcgatccccgaaggcgagctgaaatacggctgcaggctacaatttgcagccgacgattaaggaagacgacgagcgggagaggtggcccaccctcatggagcgcttgtgctcggatggcttcgcatttccccattactacattaaaccgtatcatctgaagaggatccacagagctgtcttacgtggtaatctggagaaactgaagtaccttctgctcacgtattatgacgccaataagagagacaggaaggaaaggactgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccgatccaaatattacggatgtctttggaaggactgctctgcactacgctgtgtataatgaagatacatccatgatagaaaaacttctttcacatggtacaaatattgaagaatgcagcaaggtataggtcaaccaatgttattttcaaactatctgaaatgcatttattttaacattgacacatgtaagggtcaatttttcatatttggaagctcaaacattccttgaatgaaaatattttgaaatgccttaactgtctaagattttactttaaatattggaacttttaaagaagcattatagggaacagccttttttcatgcacttatggtaaataactataaaaacaaatgaattacaataaatttataattcatgacaactgaatttgggaaaggtaatagttaagtgtttttccactaaattactttttttctaatcagtgtgaagtgacacaggaaagtaaaattgtcccttataaataggctttattttaaatgtcaaagaaaattaaagaatttcacaataaatgtacatgttgttgc

SEQ ID NO: 12036 - DNA, 1104 bp, Homo sapiens
atggggagcgcgcaggtggggatgggagtagcaggcagggcgggggcccacgggcttctcactgacccagtcccgccgtcggcagccgccccggcgcccgtgacgctcctgcgggttcacccgaccgccaactgcagcacctcccttgttcctcggctacggctggcgtcacttccggcggcgttgccaagcaaccgcgtggtacgagtaacaactccaccggctggcgtccgcggcgcttggcgccacagtcacttttccagatctaggagcatcatggacacctcgtcagagatgctggtacggtttggacggcgctgtggacgggcgaaggaaagtacagaaataagaaactctgaagaagatcaagttctctatctgcctcttctacctagcaaagtagatctccagcaggtcaccataattccacacgatgagtggaaaaggattcaagatagccttgacaggttgacaagagaagcagcatgcctccgtgcagaaagaaaggcaaagaaagaaatgcatttgcgatctcaagaagtggtaaaacactggactaatacatatgcagggatgaaagaacagaaacttgaagccaaaaagaagcgtgatgaagaaatagaggcagaaagacaaattcttgatctggaagaagaaatatacaaacaaggaaaaagaaaaaaggccattgaaaatgcaaagcaatatcaattttaccagacagaaagagtgaaaaactttcattcgggacttcttcttagtagagttatgaaagaacgtgatgcccagattgaattccgaaagagtaagataaaatcagataaaaaatgggaggaacagttgaaactcaacattgaaaaagcttttaaagaagaacaagaaaaagcagaaaaacgacacagagaaagggtggctcttgccaaagatcatctaaaacaaataaaggaacatgaggaagaagaggaaagaaggaaaaaatatgaagaaaaagatgctgaggaaataaagcgacagaatgcattatatgaaattgaaatgagaaaaaaactagaaaagaaaagagaagagatgcatgaaagcaggagacggtttcttgtaagttga

SEQ ID NO: 12037 - DNA, 5271 bp, Homo sapiens
ggtccggcagagatcgcggagagacgcagaacgcagcccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 12038 - DNA, 5331 bp, Homo sapiens
ggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctg

SEQ ID NO: 12039 - DNA, 1742 bp, Homo sapiens
tgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacagcaactggatgatgctcgcaacaaagctgacaatcaagaaaaggcaatacttaatattcaagccagatgtgatgctagagtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaacttcaagaaacacaggatcaacttacagctactataagatgtactaaggggatggaaggcgacgcacaaaagcttgaagtagaaaatgccatgatgagaaaaactattaaaaaacaggatgaccaaattgagcgacttgagaaaatcctgcagcgttcaagtttgatgccacaggtgttcaagagctagatgaagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtat

SEQ ID NO: 12040 - DNA, 5390 bp, Homo sapiens
agagtctgtgcgaaggtaggtggacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacagcaactggatgatgctcgcaacaaagctgacaatcaagaaaaggcaatacttaatattcaagccagatgtgatgctagagtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaagtaagtatcaagaaaaataagtatttttcaaacttcctgaagtaaaatttaaagtaatatttggttacagctgaatgttggatctagttgaatataaaaaagatacatatgataaatatatctgctatatcagcttagaaacattccttttttccagcaagtcaaagttagaactgagagatgctttcctctgattaaagtcaatgtgtcacttataaaattttaagttataaaatgttaatatagactaatattaataatgtagtcttatactgctgaaataataattttaatgtatttatgttgcaacattttaagaccatgataaatcagatatatggaaatgctcatacctaaaatggtattttgaaattgattcaattaaatggggtactttgacagttaatttcagatttcctagatgaactgaagtgtattccctatttcataattacttttcttcagtagcttgaaatatgtctttgttggtaaaattttgtttttcttcatgtcaatttgacttaaatctgaaactatttcaatctcaaattatgtagagatatgatcattctattctttaaaggcgtctaattttacttatattataatatggggaaaatgcagtaaattttagccaaatcatgtttgattttatcttcccactggcatttataatttactttcagtttttaaacaaagaatttgctcataatttttatttcaaggctcaattactatcatttggatataactttgtccaggacaaagagaggcatagctatctgtgatttattagtttgacactggatccccgttttcagactaaggaggatttcagactaatgaggagtggcaggattcacgcagagtaggaatggagtgagtcagggaggagagatacagcagctgagtcagggcaggaggtggagggcaggttacttagagcatctaaggccactggagttttacttttcttctgagatagacatctattggaaggatttaagcagatgatttaatgtgaggaactctgaggttgatttgagtttgtaataaaaaaaagagggaaatcattccacaatgtagaatttaccaccatcagtctcacccacatactcatttctttttgagacttcagaaggtttttaagcattgcagattcatcaggggaggaatgactagtgggctgaatatgctatgtgaataacaataccagtttggcaggaagataacaccttctgtatccttaactggattcagtaatgaacagggacgtgtacacatgaggaaaagaaggtgaatcggtctgtgtggtggtatttttcaaagtgtatgctttagagttaaatattattaatggtttaataataaggtgatttgtaaaatcagtaacaaaaataacatcaggtagctgtgagacagctttaacaaaaatgagatgatgtcttaaacaaacaatcagcaacaaaagctttgctggatgcttcatcgcgtcactgcatctatttagaaaatgagatgcaggattcaaggaagaaattagaccagatgagaagtcaagtatgtatgcaactttgcacgccaacaactgttaatctgtagctggttaactaatataaagtgttttggggtactaattttagtggatggctttcttttgtatttttattataattaattttattaaaattttatagtggatggctttcttttgtattttccttattattaattttattacaattttattataatgccacctataccttaatctctggctttcattctgccgttttttatacatatgtttttttcttaaatatttaaccttaggaaagttgagaattatgcatcatttctcacataagttgagagagttttttttcctgttaaacagtctatttttaatgatttctctattggcatggtgaggcaagccagattaattcagaggataatgtctaatggaatgtttcagaaaattatcttatttttagtctctacttttctgaatgtataaagaacgtgtgtatacttatttcatagatttcaggttaacttgttcagaaaggccattttactgaataaatttttatttcgatgaaaatccttactctctttgtattgggctcagagagcacactctgtctctatatgaatatggacagttagcatttgccaacatgtatctattttctcttatttatagaaaaagctaaactaaaatgggggttataggtcagcaaaggatgggtttgagatgtttgggttggttgagtgggcatttagacaacaagccttctcctttggcgtgtttaatggacatctttgcagtttaagatgatgcttttaaattacttctctcctaatgatgacttgagtcctgctattcaatgggagagtcaataagatcctgtaggatcttatttggaactgactttgtcgattttaattttgttcctgcttgtttttaaattttcttgttgtttccctagaaaggaaagatgacgcttggttttaaatatttaaaaatgtgcaagttgctttgctataataaaactaaatgcatacatacaaaaaataacattatagttgatgtggtagtgtttggaattcaaaatataaatgcttagcatgaggtaatcctttatctttccacattttaccagtttgtaagtttgagtatgtaactgataaaatgtaattcaaaagcaagaagaatgttgtgtttcagtcctagagcaggggtcagtgaactttctgtaaagggccagatagtattatttaaggctttgtgaaccataagatccttgttgcaataactcagccctgtagttatagcacaaaagtagccattaacgatatgcagattgaaggggtgtagcagtgtcccactaaaattaattacaaaaaacaggtaatgggatgatttctcctacattatgaccttttttaaataaaaaagattgtgatagtctaaaatattttatatatattttgttgattcattcatctactgatggacatttaggtcatttctaaatgtaattttttttaattctttgttttagcttcaagaaacacaggatcaacttacagctactataagatgtactaaggggatggaaggcgacgcacaaaagtaaaatttgaagcagcgcacaaaataacttgagtatttataaagcaaaagagcactgtagtatgaaaattgtatcagttatgataataagtatgtctttgtgaagccgaaaaagtttcatttgtaagctgtattgaaatacatcatttttctacattattcctaaattttgcatattatcgacaaaacacagttagaaaaatgacacagtagcccaatcatctacttttgtgatcgctaagaatttgtgtaattataccttcagaagtttgtttagaatttacatgataaaaaaaattatgtgtgagagtaattattttaaaatgcacattttaggcttgaagtagaaaatgccatgatgagaaaaactattaaaaaacaggatgaccaaattgagcgacttgagaaaatcctgcagcgttcaagtttgatgccacaggtgttcaagagctagatgaagatatcaacctatgaattgcctctaccaaaaagcctacaatattgacacaaacctgggctagtatcccttctatgtcttctaataagtgctgtcttatgcctgtcactgtatgtatgactctgtatgggaattgcctgtttgttttttcagattatagcaaacagttgttgaggggtggaccatatcatctttatcttgtaattccagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtat

SEQ ID NO: 12041 - DNA, 2193 bp, Homo sapiens
atgggttctgaagagctaagggagttgaggatgcaccgattttggtatgggggtacgacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagctta

SEQ ID NO: 12042 - DNA, 1742 bp, Homo sapiens
tgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcacatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacagcaactggatgatgctcgcaacaaagctgacaatcaagaaaaggcaatacttaatattcaagccagatgtgatgctagagtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaacttcaagaaacacaggatcaacttacagctactataagatgtactaaggggatggaaggcgacgcacaaaagcttgaagtagaaaatgccatgatgagaaaaactattaaaaaacaggatgaccaaattgagcgacttgagaaaatcctgcagcgttcaagtttgatgccacaggtgttcaagagctagatgaagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtat

SEQ ID NO: 12043 - DNA, 5393 bp, Homo sapiens
agagtctgtgcgaaggtaggtggacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcacatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacagcaactggatgatgctcgcaacaaagctgacaatcaagaaaaggcaatacttaatattcaagccagatgtgatgctagagtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaagtaagtatcaagaaaaataagtatttttcaaacttcctgaagtaaaatttaaagtaatatttggttacagctgaatgttggatctagttgaatataaaaaagatacatatgataaatatatctgctatatcagcttagaaacattccttttttccagcaagtcaaagttagaactgagagatgctttcctctgattaaagtcaatgtgtcacttataaaattttaagttataaaatgttaatatagactaatattaataatgtagtcttatactgctgaaataataattttaatgtatttatgttgcaacattttaagaccatgataaatcagatatatggaaatgctcatacctaaaatggtattttgaaattgattcaattaaatggggtactttgacagttaatttcagatttcctagatgaactgaagtgtattccctatttcataattacttttcttcagtagcttgaaatatgtctttgttggtaaaattttgtttttcttcatgtcaatttgacttaaatctgaaactatttcaatctcaaattatgtagagatatgatcattctattctttaaaggcgtctaattttacttatattataatatggggaaaatgcagtaaattttagccaaatcatgtttgattttatcttcccactggcatttataatttactttcagtttttaaacaaagaatttgctcataatttttatttcaaggctcaattactatcatttggatataactttgtccaggacaaagagaggcatagctatctgtgatttattagtttgacactggatccccgttttcagactaaggaggatttcagactaatgaggagtggcaggattcacgcagagtaggaatggagtgagtcagggaggagagatacagcagctgagtcagggcaggaggtggagggcaggttacttagagcatctaaggccactggagttttacttttcttctgagatagacatctattggaaggatttaagcagatgatttaatgtgaggaactctgaggttgatttgagtttgtaataaaaaaaagagggaaatcattccacaatgtagaatttaccaccatcagtctcacccacatactcatttctttttgagacttcagaaggtttttaagcattgcagattcatcaggggaggaatgactagtgggctgaatatgctatgtgaataacaataccagtttggcaggaagataacaccttctgtatccttaactggattcagtaatgaacagggacgtgtacacatgaggaaaagaaggtgaatcggtctgtgtggtggtatttttcaaagtgtatgctttagagttaaatattattaatggtttaataataaggtgatttgtaaaatcagtaacaaaaataacatcaggtagctgtgagacagctttaacaaaaatgagatgatgtcttaaacaaacaatcagcaacaaaagctttgctggatgcttcatcgcttcactgcatctatttagaaaatgagatgcaggattcaaggaagaaattagaccagatgagaagtcaagtatgtatgcaactttgcacgccaacaactgttaatctgtagctggttaactaatataaagtgttttggggtactaattttagtggatggctttcttttgtatttttattataattaattttattaaaattttatagtggatggctttcttttgtattttccttattattaattttattacaattttattataatgccacctataccttaatctctggctttcattctgccgttttttatacatatgtttttttcttaaatatttaaccttaggaaagttgagaattatgcatcatttctcacataagttgagagagttttttttcctgttaaacagtctatttttaatgatttctctattggcatggtgaggcaagccagattaattcagaggataatgtctaatggaatgtttcagaaaattatcttatttttagtctctacttttctgaatgtataaagaacgtgtgtatacttatttcatagatttcaggttaacttgttcagaaaggccattttactgaataaatttttatttcgatgaaaatccttactctctttgtattgggctcagagagcacactctgtctctatatgaatatggacagttagcatttgccaacatgtatctattttctcttatttatagaaaaagctaaactaaaatgggggttatagaaggtcagcaaaggatgggtttgagatgtttgggttggttgagtgggcatttagacaacaagccttctcctttggcgtgtttaatggacatctttgcagtttaagatgatgcttttaaattacttctctcctaatgatgacttgagtcctgctattcaatgggagagtcaataagatcctgtaggatcttatttggaactgactttgtcgattttaattttgttcctgcttgtttttaaattttcttgttgtttccctagaaaggaaagatgacgcttggttttaaatatttaaaaatgtgcaagttgctttgctataataaaactaaatgcatacatacaaaaaataacattatagttgatgtggtagtgtttggaattcaaaatataaatgcttagcatgaggtaatcctttatctttccacattttaccagtttgtaagtttgagtatgtaactgataaaatgtaattcaaaagcaagaagaatgttgtgtttcagtcctagagcaggggtcagtgaactttctgtaaagggccagatagtattatttaaggctttgtgaaccataagatccttgttgcaataactcagccctgtagttatagcacaaaagtagccattaacgatatgcagattgaaggggtgtagcagtgtcccactaaaattaattacaaaaaacaggtaatgggatgatttctcctacattatgaccttttttaaataaaaaagattgtgatagtctaaaatattttatatatattttgttgattcattcatctactgatggacatttaggtcatttctaaatgtaattttttttaattctttgttttagcttcaagaaacacaggatcaacttacagctactataagatgtactaaggggatggaaggcgacgcacaaaagtaaaatttgaagcagcgcacaaaataacttgagtatttataaagcaaaagagcactgtagtatgaaaattgtatcagttatgataataagtatgtctttgtgaagccaaaaaagtttcatttgtaagctgtattgaaatacatcatttttctacattattcctaaattttgcatattatcgacaaaacacagttagaaaaatgacacagtagcccaatcatctacttttgtgatcgctaagaatttgtgtaattataccttcagaagtttgtttagaatttacatgataaaaaaaattatgtgtgagagtaattattttaaaatgcacattttaggcttgaagtagaaaatgccatgatgagaaaaactattaaaaaacaggatgaccaaattgagcgacttgagaaaatcctgcagcgttcaagtttgatgccacaggtgttcaagagctagatgaagatatcaacctatgaattgcctctaccaaaaagcctacaatattgacacaaacctgggctagtatcccttctatgtcttctaataagtgctgtcttatgcctgtcactgtatgtatgactctgtatgggaattgcctgtttgttttttcagattatagcaaacagttgttgaggggtggaccatatcatctttatcttgtaattccagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaatatttttgtat

SEQ ID NO: 12044 - DNA, 300 bp, Homo sapiens
atgacatcagggtgcgtagtctctggaaaagtccactgtgtgcttgcgaatgaaagagggcggaaaaggcacatcacatcttactattggctgaaaatagctgtggcctcgggaacctctgcgagaggagtcccgaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtga

SEQ ID NO: 12045 - DNA, 853 bp, Homo sapiens
gacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccac

SEQ ID NO: 12046 - DNA, 853 bp, Homo sapiens
gacagactgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcacatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccac

SEQ ID NO: 12047 - DNA, 8076 bp, Homo sapiens
gtggccggggctgcggcgcggggggcggggcggtcgggcccgggacaccccctcccggtcccctggcggggcagcgtcggctctggcagcactggaggcggcggcggcccgagggcgacttgcggggcgcgcaggccgccgtgcacccgggacgcttccccctcggggaccctccgcgggcttctccgccgcgccgtccggcgggagccggcgggaccccgggcgagcggcgcgggcggcaccatgaggcggcagtggggcgcgctgctgcttggcgccctgctctgcgcacacggcctggccagcagccccgagtgtgcttgtggtcggagccacttcacatgtgcagtgagtgctcttggagagtgtacctgcatccctgcccagtggcagtgtgatggagacaatgactgcggggaccacagcgatgaggatggatgtatactacctacctgttcccctcttgactttcactgtgacaatggcaagtgcatccgccgctcctgggtgtgtgacggggacaacgactgtgaggatgactcggatgagcaggactgtcccccccgggagtgtgaggaggacgagtttccctgccagaatggctactgcatccggagtctgtggcactgcgatggtgacaatgactgtggcgacaacagcgatgagcagtgtgacatgcgcaagtgctccgacaaggagttccgctgtagtgacggaagctgcattgctgagcattggtactgcgacggtgacaccgactgcaaagatggctccgatgaggagaactgtccctcagcagtgccagcgcccccctgcaacctggaggagttccagtgtgcctatggacgctgcatcctcgacatctaccactgcgatggcgacgatgactgtggagactggtcagacgagtctgactgctcctcccaccagccctgccgctctggggagttcatgtgtgacagtggcctgtgcatcaatgcaggctggcgctgcgatggtgacgcggactgtgatgaccagtctgatgagcgcaactgcaccacctccatgtgtacggcagaacagttccgctgtcactcaggccgctgtgtccgcctgtcctggcgctgtgatggggaggacgactgtgcagacaacagcgatgaagagaactgtgagaatacaggaagcccccaatgtgccttggaccagttcctgtgttggaatgggcgctgcattgggcagaggaagctgtgcaacggggtcaacgactgtggtgacaacagcgacgaaagcccacagcagaattgccggccccggacgggtgaggagaactgcaatgttaacaacggtggctgtgcccagaagtgccagatggtgcggggggcagtgcagtgtacctgccacacaggctaccggctcacagaggatgggcacacgtgccaagatgtgaatgaatgtgccgaggaggggtattgcagccagggctgcaccaacagcgaaggggctttccaatgctggtgtgaaacaggctatgaactacggcccgaccggcgcagctgcaaggctctggggccagagcctgtgctgctgttcgccaatcgcatcgacatccggcaggtgctgccacaccgctctgagtacacactgctgcttaacaacctggagaatgccattgcccttgatttccaccaccgccgcgagcttgtcttctggtcagatgtcaccctggaccggatcctccgtgccaacctcaacggcagcaacgtggaggaggttgtgtctactgggctggagagcccagggggcctggctgtggattgggtccatgacaaactctactggaccgactcaggcacctcgaggattgaggtggccaatctggacggggcccaccggaaggtgttgctgtggcagaacctggagaagccccgggccattgccttgcatcccatggagggtaccatttactggacagactggggcaacaccccccgtattgaggcctccagcatggatggctctggacgccgcatcattgccgatacccatctcttctggcccaatggcctcaccatcgactatgccgggcgccgtatgtactgggtggatgctaagcaccatgtcatcgagagggccaatctggatgggagtcaccgtaaggctgtcattagccagggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcagggaaaaaccgctgtggggacaacaacggaggctgcacgcacctgtgtctgcccagtggccagaactacacctgtgcctgccccactggcttccgcaagatcagcagccacgcctgtgcccagagtcttgacaagttcctgctttttgcccgaaggatggacatccgtcgaatcagctttgacacagaggacctgtctgatgatgtcatcccactggctgacgtgcgcagtgctgtggcccttgactgggactcccgggatgaccacgtgtactggacagatgtcagcactgataccatcagcagggccaagtgggatggaacaggacaggaggtggtagtggataccagtttggagagcccagctggcctggccattgattgggtcaccaacaaactgtactggacagatgcaggtacagaccggattgaagtagccaacacagatggcagcatgagaacagtactcatctgggagaaccttgatcgtcctcgggacatcgtggtggaacccatgggcgggtacatgtattggactgactggggtgcgagccccaagattgaacgagctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccgttggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagatggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatc

SEQ ID NO: 12048 - DNA, 7062 bp, Homo sapiens
atctgcttaaaggggccgcgagcacttacctcccgccctgctccccgccgccccgccaccgcgtcttcagggctcccggcaactggctggaagggcttccctcaccctcagtaacagcctgccagcgaggagaggcgagccgggcgggaggcaaagaggaggcaccgcatttgtaaaaggcaagagagaaaggaaggaaggaaaaaaaaataacccgagcggcgcagagtggactctggtccgggagagcacgggcgggcgccggaacgtggacccagaggcaccggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagagatgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctaggtctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgta

SEQ ID NO: 12049 - DNA, 7235 bp, Homo sapiens
atctgcttaaaggggccgcgagcacttacctcccgccctgctccccgccgccccgccaccgcgtcttcagggctcccggcaactggctggaagggcttccctcaccctcagtaacagcctgccagcgaggagaggcgagccgggcgggaggcaaagaggaggcaccgcatttgtaaaaggcaagagagaaaggaaggaaggaaaaaaaaataacccgagcggcgcagagtggactctggtccgggagagcacgggcgggcgccggaacgtggacccagaggcaccggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagagatgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtctcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctaggtctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgta

SEQ ID NO: 12050 - DNA, 4611 bp, Homo sapiens
gtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattgg

SEQ ID NO: 12051 - DNA, 1550 bp, Homo sapiens
gcggagcggagcggcggcgggcgcagctagcgggtcggccgcggagcggaggtgcagctcggcttcccccggcacccctccccctcgggcgccagccccacccctccgccggccgggccgaccccgccgtactatcccctgcggcgcgagcccggggcggctccaagcgccccccagcagacccccatcatgggcagccagagctccaaggctccccggggcgacgtgaccgccgaggaggcagcaggcgcttcccccgcgaaggccaacggccaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtcttttttttctcccactgttgtaaataacttttaatggccaaaccccagatttgtacttttttttttttctaactgctaaaaccattctcttccacctggttttactgtaacatttggaaaaggaataaatgtcgtccctttaaaaaaaaaaaaaaaa

SEQ ID NO: 12052 - DNA, 2470 bp, Homo sapiens
ggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaagaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttttaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagac

SEQ ID NO: 12053 - DNA, 1662 bp, Homo sapiens
tggggattactcagtgttgagagaaacaacacggaaagcccagagcagaggagggagaaggccccattctctcagctttaatctactgcacctcggagggcagagctctaaccagacacgctgcaagcatcagaatcgggatgaacatcgaggtggggaacatttcttatacaggagccatcatctcctggtcgtcctcggagccctgcctggaggactattaccatattatgtacaggcccaactggaacagcatcttctctggctatcttcgctacagcttccacaacgaggagaaggtgcctcgaacgatcagctccgtggtgctggaacatcttgccccttccactctctacttcctgtgcatcagctgtaagaaggctgccttcccttacaggcactactgcaccatgttccacaccctggataagagtccgctggctcctggaagctccctggtagacccccagatctccctttgggtgctgatggccattctgctggcctgcttcacagccgtcttggccttcatctgcctccagttctggtgtgtccgttgccatgagccgcgatggtcttacagggctggccacatggaggaggccaatgggttggtgagatggccagaggaggccccggatcttggtcagagggaggaagacctgcaggggctccccctggtggaaatgccacgcaagaactccagagatggagctgaactggatcccgaagccaaccaggatgcccctgatgcgggtgccttacagagggggggtggtgacccacccgctatactgcctcattgtggggaatgagagtggggaggagagcgcccgcatcatgtagcctaaagctttccacacagtaggtcgtttgtacaaatgtgtctatagactacccatttctctcccatcaaacgtcactgctattgtaggtcacctgggttggatgaatgccccatgacaaagcttctcaagctggaaaatgtatcccccagggtatgccaaggcacaaacgaggcatctcagcagcagcgtccactcggaggacacagttaagaattgaaagcattgttttaacattaaaacaaacatggatatgttataaagtagaaagcaaaaatttgcatgacttaaataaaacacagcacttgaaggaaacacttgagttacaagtaggctctcagaggtacacttttgggcaaaggtagatgtccagtttcctctgcccttgaggggattatttggaaataatttgggattatttggaaataatttgtgagaacccttgctctggagtgttttccaacttttaggcaatcacataccaccgctctctattttttaaaaccatggattatcttcactattattaataatactttcctttaaattgactcattttttaagcgtaaacttattttcaaagacagccttatattactccataagtgaaaaaccagcaccctcctgctgcaaacagaagggaagagacataagaataaacatcatgaaaacaagataatattaaataatctgacttagcttctattgcctgccagtgattctgagcttaatgcctgcttgcttgtctttgataaaaagggagatccagtgttggagaggtaataaagacatattagcaccaaaaaaaaaaaaaaaa

SEQ ID NO: 12054 - DNA, 705 bp, Homo sapiens
ggcaagatggcagcggcgctgcgcgtgcgttgttgagtgttcgggacgccggcctgcaggcgccatggtcttcctcaccgcgcagctctggctgcggaatcgcgtcaccgaccgctactttcggatccaggaggtgctgaagcacgccaggcacttccggggaaggaaaaatcgctgctacaggttggcggtcagaaccgtgattcgagcctttgtgaaatgcaccaaagcccgatacctgaagaaaaagaacatgaggaccctctggattaatcgaattacagctgctagccaggaacatggactgaagtatccagcgctcattgggaatttagttaagtgccaggtggagctcaacaggaaagtcctagcggatctggccatctacgagccaaagactttcaaatctttggctgccttggccagtaggaggcgacacgaaggatttgctgctgccttgggggatgggaaggaacctgaaggcattttttccagagtggtgcagtaccactgaggactgttgctgtattgattaggaaaagagacagagtaatttgcagtttgtttgatttatacttttgtttatctacaacccaataacagacatgagggatggccctgtctctctgggacagagcctcacagatgatgtccatgttttgtgtgaatgaaactcaaacaaaaaaaaaaaaaaaaaaaaaaaaa

SEQ ID NO: 12055 - DNA, 2666 bp, Homo sapiens
tgcgttgtccagaaggaacttcgtcctgcgtgagcctggattaatcatgagagagctcgtcaacattccactggtacatattcttactctggttgccttcagcggaactgagaaacttccaaaagctcctgtcatcaccactcctcttgaaacagtggatgccttagttgaagaagtggctactttcatgtgtgcagtggaatcctacccccagcctgagatttcctggactagaaataaaattctcattaaactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgaaacctaaaataactcgccctcccataaatgtgaaaataatagagggattaaaagcagtcctaccatgtactacaatgggtaatcccaaaccatcagtgtcttggataaagggagacagccctctcagggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgaggtttttgccaggatcctgcgggctcctgaatcccacaatgtcacctttggctcctttgtgaccctgcactgtacagcaacaggcattcctgtccccaccatcacctggattgaaaacggaaatgctgtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcagaatggagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctagattataacaaagaaaacctaaaaacattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagac

SEQ ID NO: 12056 - DNA, 5280 bp, Homo sapiens
gttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcagactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctct

SEQ ID NO: 12057 - DNA, 5485 bp, Homo sapiens
gactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 12058 - DNA, 5617 bp, Homo sapiens
gactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 12059 - DNA, 5527 bp, Homo sapiens
gactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 12060 - DNA, 5395 bp, Homo sapiens
gactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 12061 - DNA, 3699 bp, Homo sapiens
gctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttt

SEQ ID NO: 12062 - DNA, 3058 bp, Homo sapiens
ggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcacgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggtttttttgatatcttaaaataatttgtcttattttttgatggtttgaatgcttgctttcttgtagtatcctttcacttgttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggttttt

SEQ ID NO: 12063 - DNA, 1897 bp, Homo sapiens
acttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaaca

SEQ ID NO: 12064 - DNA, 2061 bp, Homo sapiens
gccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtgtatgttcgtgtacacttggctgtcaggctttctgtgcatgtactaaaaaaggagaaattataataaattagccgtcttgcggcccctaggcctaaaaaaaaaaaaaaaaaaaa

SEQ ID NO: 12065 - DNA, 2184 bp, Homo sapiens
ctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaa

SEQ ID NO: 12066 - DNA, 4261 bp, Homo sapiens
gcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctcaaaaaaaaaaaaaaa

SEQ ID NO: 12067 - DNA, 2582 bp, Homo sapiens
gttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgaggtctcaatccattgcgcccaggctggtatgcagtcatgttgtatctggaattggtgggttcttggtctcactgacttcaagaatgaagccgcagaccctcgtgcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccat

SEQ ID NO: 12068 - DNA, 7111 bp, Homo sapiens
gcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattcatctc

SEQ ID NO: 12069 - DNA, 4407 bp, Homo sapiens
ttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaaga

SEQ ID NO: 12070 - DNA, 3647 bp, Homo sapiens
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttaaa

SEQ ID NO: 12071 - DNA, 3503 bp, Homo sapiens
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttaaa

SEQ ID NO: 12072 - DNA, 3470 bp, Homo sapiens
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttaaa

SEQ ID NO: 12073 - DNA, 3614 bp, Homo sapiens
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttaaa

SEQ ID NO: 12074 - DNA, 2381 bp, Homo sapiens
ggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacaaaaaaaaaaaaaaaaaaaaaaa

SEQ ID NO: 12075 - DNA, 2702 bp, Homo sapiens
ccccctttttaaccacaaaccgaattttctttcatttaggtgatctatatatatctatatcgtatagcttatagcttatatctattttaaataacttaaagccgctaaaatttgggggggaacagctttcgccctggagcggtgcgcgatgctgtctcatgccgacctcctggacgccaggctaggtatgaaagatgccgccgagcttctgggccaccgggaggcggtgaagtgtaggctgggcgtggggggctccgaccccgggggccatccgggggacctggcgcccaactctgacccagtggagggagccactctgctgcccggggaggacatcaccacagtgggctctactccggcctcgctggcggtgagcgccaaagacccggacaagcagcccgggccccagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggtctggttccagaaccgacgcgccaagtggaagaagcgcaaaaagacgaccaacgtgttccgtgcgcccggcacactgctgcccacgccaggcctgcctcagttcccgtcggctgccgccgccgctgccgccgccatgggcgacagcctgtgctctttccacgccaacgacacccgctgggcggcggccgccatgcctggcgtgtcacagctgcctctgccgccggcgctgggcaggcagcaggccatggcgcagtcgctgtcccagtgcagcctggcggccggtccgccgcccaactccatgggcctgtccaacagcctggcgggttccaacggcgcggggctgcagtcgcacctctaccagcccgccttccccggcatggtgcccgcctccctccccggccccagcaacgtctccggttcgccccagctctgcagctccccggacagcagcgacgtgtggcggggcaccagcatcgcctccctccgccgcaaggcgctagagcacacagtctctatgagcttcacttaatgcagccgcgccccggcccgctccgcccccagcaccgccccgggggccgccccgaggcccttccggcgcgcacccggaccccggcgccctgccccgtcccgccccggccttcgccccgtctcgtttcgtcctcgcctctctcctccactcgctcgggctcaccccaagccccagcccgcgaggcctcccctccgcctgatttcgatcgcccgcggtcccccgtctcccggccgcccctcttcccttcccacccagctgcgccctcggctcggtctccagcgcctcagcccacccttcccgccaccctggcctccctgcttgcgctggccgtgctcgcgccctcctcctggccttctgacgggcggcgttcccacccacaccttcgacgcgacgcctacgacccccctcgcccgccgcctcccctccggtcccctctttccccacacttcgcgaccctcctcccgcgcccggcaaaaagtatccttcccgccattttacgtaccagggagtcgactcaggatctgaaatcagacaccaatggactggtttgtgggcagaaacacacacactcgcactctcgctcacgctcagacgctacacacgcgcgcgcacagacacggtgcacctaggtcacacacggacgtgttcaagggacagcacaatgttagggatttttgtcttaaaggaggacaagcattgctaccaaccgcctcatctgagggcccaactgatatgatttgatttatccttgtactctccaagctcctgtctttctttcctctcccaccacgctacccttgcccagtccacccagtcacatccgtgcagccctctcttggcttgcaagataacgcttttatttttattttatcttattttcattttcttaagcacaactgtgtgagagtgtagaagggaaggcttctcaggaggaacgtgacagtggattgggtggctggagtagactaaagcagtcatgtgacgaggaagaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggacaagtttatatcaagttaaatgtaaatggataaaataaaatcattttcagtatgtgaaaaaaaaaaaaaaaaaaaaaaaaa

SEQ ID NO: 12076 - DNA, 2869 bp, Homo sapiens
cccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgaaaaaaaaa

SEQ ID NO: 12077 - DNA, 1819 bp, Homo sapiens
cttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctctgccccagttggggcaggggcaggagggagggtttctctcccaagctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagacttcccggggtccccgccctctctcatatcactgaaggatattttcaacaattagaggaatttaaagaggaaaaaaattacaaagaaaataataaaagtgtttgtacgttttcaaaaaaa

SEQ ID NO: 12078 - DNA, 4111 bp, Homo sapiens
gtttgccaaaggagtcgggcctgacggtggaagatgggaaatggccaaaagaataaaccatttcctcttacttaccgaatgaaaagcttgcttcatcttggcgttcaagactctctaatatgattccacctgttgggctctttcttccatttgcctccgcagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtgtctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccggttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 12079 - DNA, 4041 bp, Homo sapiens
agttctggaaagtcattgacaggggattaacctagaacatcaattataaacaggcagcaggcctcaggcccagacttgggtgttacaggaacagtgtggcctctctggaactctgcagaccacctgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtgtctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccggttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 12080 - DNA, 4299 bp, Homo sapiens
agcggagcgaaggcgcgagctgcccgataatggcggcctgcagagcccatgagagggagaagcggcagcgtctaccctgaggaaggtgctcttccccatggggactgtaccaggctggagaggacatggcactgcttcagagacacgaaccaccttgagtggatgtgattggcgatccccgtagagcaggaaagctcgtctgctgtgcagccggcgcagaggattctgtggcaggaaattagacactaggaaattcagtagcgatttgaaggaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaggtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaatcccaaaatggaacttctcattcctgtgaagaaaaaatctatgaatgggcgaatgaaacaactgattaaggaaatgctggctgcaaaccctcaggatcgtccagatgcttttgaactagaactcagattagtacaaattgcatttaaagatagcagctgggaaacgtgacacatattatttgcaaataccatggatgatatgctgcttctgtttaacagtgatgcaacattatgtggctgaaaaagaatataaaaagctagactctaccctctaagggtttagattttttgtgggatttttttttttcctcatttttcttaaatccaagttggccgttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgtttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaaccgaaaaaaaaaaaaaaaa

SEQ ID NO: 12081 - DNA, 3856 bp, Homo sapiens
agcggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcccagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgtacacttgagttaagcagtagtgtttgggaagaaaaacagaggagttctattaagacggttgaattaataaaaggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtgaaaatcacatcaacactgcaagtgttgaagcttatcaagcaggctggtgaccgagtcctggtgtactatgaaaggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttacaaaaaaaaaaaaaaaa

SEQ ID NO: 12082 - DNA, 1410 bp, Homo sapiens
acccccgagcccccgcagccctagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattcaaaaaaaaaaaaaaaaaa

SEQ ID NO: 12083 - DNA, 1481 bp, Homo sapiens
acccccgagcccccgcagccctagagccgcccaagggatggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgaggaaggttggtaattgtggctacttcatacaacagagttgagcattcattgtttagagtttgtgaatttcagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattcaaaaaaaaaaaaaaaaaa

SEQ ID NO: 12084 - DNA, 1323 bp, Homo sapiens
cacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaagggaagcaggacttcttaattacttacttgaagaaatattagacaaagttcattcaattccagaaaaactcatggatgagacttacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatactaaaa

SEQ ID NO: 12085 - DNA, 3213 bp, Homo sapiens
atgtgcttcagtttcataatgcctcctgctatggcagacatccttgacatctgggcggtggattcacagatagcatctgatggctccatacctgtggatttccttttgcccactgggatttatatccagttggaggtacctcgggaagctaccatttcttatattaagcagatgttatggaagcaagttcacaattacccaatgttcaacctccttatggatattgactcctatatgtttgcatgtgtgaatcagactgctgtatatgaggagcttgaagatgaaacacgaagactctgtgatgtcagaccttttcttccagttctcaaattagtgacaagaagttgtgacccaggggaaaaattagactcaaaaattggagtccttataggaaaaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggacgtgtttagctttcaagtgtctcctaatatgaatcctatcaaagtaaatgaattggcaatccaaaaacgtttgactattcatgggaaggaagatgaagttagcccctatgattatgtgttgcaagtcagcgggagagtagaatatgtttttggtgatcatccactaattcagttccagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctcatgtttgggaaaataacaaccctttccaaattgtcttggttaagggaaataaacttaacacagaggaaactgtaaaagttcatgtcagggctggtctttttcatggtactgagctcctgtgtaaaaccatcgtaagctcagaggtatcagggaaaaatgatcatatttggaatgaaccactggaatttgatattaatatttgtgacttaccaagaatggctcgattatgttttgctgtttatgcagttttggataaagtaaaaacgaagaaatcaacgaaaactattaatccctctaaatatcagaccatcaggaaagctggaaaagtgcattatcctgtagcgtgggtaaatacgatggtttttgactttaaaggacaattgagaactggagacataatattacacagctggtcttcatttcctgatgaactcgaagaaatgttgaatccaatgggaactgttcaaacaaatccatatactgaaaatgcaacagctttgcatgttaaatttccagagaataaaaaacaaccttattattaccctcccttcgataagattattgaaaaggcagctgagattgcaagcagtgatagtgctaatgtgtcaagtcgaggtggaaaaaagtttcttcctgtattgaaagaaatcttggacagggatcccttgtctcaactgtgtgaaaatgaaatggatcttatttggactttgcgacaagactgccgagagattttcccacaatcactgccaaaattactgctgtcaatcaagtggaataaacttgaggatgttgctcagcttcaggcgctgcttcagatttggcctaaactgcccccccgggaggccctagagcttctggatttcaactatccagaccagtacgttcgagaatatgctgtaggctgcctgcgacagatgagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtcagaagtgcacattcctgctgtctcagtacaatttggtgtcatccttgaagcatactgccggggaagtgtggggcacatgaaagtgctttctaagcaggttgaagcactcaataagttaaaaactttaaatagtttaatcaaactgaatgccgtgaagttaaacagagccaaagggaaggaggccatgcatacctgtttaaaacagagtgcttaccgggaagccctctctgacctgcagtcacccctgaacccatgtgttatcctctcagaactctatgttgaaaagtgcaaatacatggattccaaaatgaagcctttgtggctggtatacaataacaaggtatttggtgaggattcagttggagtgatttttaaaaatggtgatgatttacgacaggatatgttgacactccaaatgttgcgcttgatggatttactctggaaagaagctggtttggatcttcggatgttgccttatggctgtttagcaacaggagatcgctctggcctcattgaagttgtgagcacctctgaaacaattgctgacattcagctgaacagtagcaatgtggctgctgcagcagccttcaacaaagatgcccttctgaactggcttaaagaatacaactctggggatgacctggaccgagccattgaggaatttacactgtcctgtgctggctactgtgtagcttcttatgtccttgggattggtgacagacatagtgacaacatcatggtcaaaaaaactggccagctcttccacattgactttggacatattcttggaaatttcaaatctaagtttggcattaaaagggagcgagtgccttttattcttacctatgatttcatccatgtcattcaacaaggaaaaacaggaaatacagaaaagtttggccggttccgccagtgttgtgaggatgcatatctgattttacgacggcatgggaatctcttcatcactctctttgcgctgatgttgactgcagggcttcctgaactcacatcagtcaaagatatacagtatcttaaggactctcttgcattagggaagagtgaagaagaagcactcaaacagtttaagcaaaaatttgatgaggcgctcagggaaagctggactactaaagtgaactggatggcccacacagttcggaaagactacagatcttaa

SEQ ID NO: 12086 - DNA, 7434 bp, Homo sapiens
gctggatcctgcagtaaccacaacagcatcctctccctgcgccagggacctgccagccggagagatgactgattagatcagattagatccggagccccgctctgcagaagggggccccaggggcgggggaggaggaccccagctggcctgagctggggggaggggtgccttggggctcgcagagttagagctttccagcgcggggatcacacctcagaagccgccacaatgaaagacggaacacatttctacacccagtgactggccaggtcccagaggaaaacaaaaaatttgacttgaaaatatcgaccttggacatgtccaataaaacaggtgggaaacgcccggctaccaccaacagtgacatacccaaccacaacatggtgtccgaggtccctccagagcggcccagcgtccgggcaactcgcacagcccgcaaagccgtcgcctttggcaagcgctcacactccatgaagcggaaccccaatgcacctgtcaccaaggcgggctggctcttcaaacaggccagctccggggttaagcagtggaacaagcgctggttcgtcctggtggatcgctgcctcttctactataaagatgagaaggaagagagtatcctgggcagcatccccctcctgagcttccgggtagccgcagtgcagccctcagacaacatcagccggaaacacacgtttaaggctgagcatgccggggtccgcacctacttcttcagtgccgagagccccgaggagcaagaggcctggatccaggccatgggggaggctgctcgagtacagatccctccagcccagaagtcagtgccccaagctgtgcggcacagccatgagaagccagactcggagaacgtcccacccagcaagcaccaccagcagccaccccacaacagcctccctaagcctgagccagaggccaagactcgaggggagggtgatggccgaggctgtgagaaggcagagagaaggcctgagaggccagaagtcaagaaagagcctccggtgaaagccaatggcctcccagctggaccggagccagcctcagagccgggcagcccttaccccgagggcccaagagtgccagggggtggggaacagcctgcccagcccaatggctggcagtaccactccccaagccggccagggagcacagctttcccgtctcaggatggagagactgggggacaccggcggagtttcccaccacgcaccaaccctgacaaaattgcccagcgcaagagctccatgaaccagcttcagcagtgggtgaatctgcgccggggggtacccccgcctgaagaccttcggagtccctctaggttctatcctgtgtctcgcagggtccctgagtactatggcccctactcctcccagtaccccgatgattatcagtactacccgccaggagtgcggccggagagcatctgttccatgccggcctatgatcggatcagcccgccctgggccctggaggacaagcgccatgccttccgcaatgggggtggccctgcctaccagctgcgagagtggaaggagcccgccagctacgggcggcaggatgccaccgtctggatcccaagcccctcccggcagccagtctattatgatgagctggatgccgcctctagctccctgcgccgcctgtccctgcagccccgctcccactctgtgccccgctcacccagccagggctcctacagccgtgcccgcatttactcccctgtccgctcacccagtgcccgttttgagcggctgccacctcgcagtgaggacatctatgctgaccctgctgcctatgtgatgaggcgatccatcagctcccccaaggtccctccatacccagaagtgttccgggacagcctccacacctacaagttaaacgagcaagacacagataagctgctgggaaaattgtgtgagcagaacaaggtggtgagggagcaggaccggctggtgcagcagctccgagctgagaaggagagcctggaaagtgccttgatggggacccaccaggagctggagatgtttggaagccagcccgcctacccagaaaagctgcgacacaaaaaggattcactgcagaaccagctcatcaacatccgcgtggagctgtctcaggcgaccacggccctgacaaacagcaccatagagtatgagcacctcgagtctgaggtctctgccctgcacgatgacctctgggagcagctcaatttggacacccagaatgaggtgctgaaccggcaaatccaaaaggagatctggaggatccaggacgtgatggaggggctgaggaagaacaacccctcccggggcacggacaccgccaagcacagaggaggacttggcccctcagccacctacagctccaacagcccggccagccccctcagctctgccagcctcaccagccccctgagccccttttcactggtgtcgggctctcaggggtcccccaccaagcctggctccaacgagcccaaggcaaactatgaacaaagcaagaaagacccccaccagacattgcccctggacacccccagagacatcagccttgtgcccaccaggcaagaggtagaggcagagaagcaggcagctctcaacaaagttggcgttgtgccccctcggacaaaatcgcccactgatgatgaggtgaccccatcagcagtggtaagaaggaatgccagtgggctcaccaatggactctcctcccaggaacgccccaagagtgctgtgtttcctggcgaggggaaggtcaagatgagcgtggaggagcagattgaccgaatgcggcggcaccagagtggctccatgagggagaagcggaggagcctgcagctcccggccagcccggcccccgaccccagtccccggccagcctacaaagtggtgcgccgccaccgcagcatccatgaggtagacatctccaacctggaggcagccctgcgggcagaggagcctggcgggcatgcctacgagacaccccgggaggaaattgcccggcttcgcaaaatggagctagagccccagcattatgacgtggacatcaataaggagctctccactccagacaaagtcctcatccctgaacggtacattgacctggagcctgacactcccctgagccctgaggagttgaaggagaagcagaagaaggtggagaggatcaagacactcattgccaaatccagtatgcagaacgtggtgcccatcggcgagggggactctgtggacgtgccccaggactcagagagccagctgcaggagcaggagaagcggattgaaatctcctgcgccctggcgaccgaggcctcccgcaggggccgcatgctgtctgtgcaatgtgccaccccaagccctcccacctcccctgcttccccggctcctccagcaaaccccctgtcgtctgaatccccacggggcgccgacagcagctataccatgcgggtctgagctctgactgcaagccctggctgaggccaatgctgtgaagctccacagagccacattctgaagccgtcctctgcccacctgaggtcctggctccccaccctggccccctgcccctgcactcccatgggaatgccgcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctgctgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgcgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacacattcctcctcagctccacccacctggagacgaatgtagccagagaggaggaaggagggaaactgaaaacaccgtggcccctcggccttctctctgctagagttgccgctcagaggcttcagcctgacttccagcggtcccaagaacacctactaattcctctccactccttcatggctgggacagttactggttcatatgcaagtaaagatgacaatttactcaacaaatatttatcgagcaccttttatgtaccaggcactgttgtaggtgcttaggatattctcatgtttctgagggattacagcctgggaggattccaccgatcttcacttctagcaggttttttaaacgtgacccttggctgtatttcccatcttcacagttcaagcaccccaaacctgccctttctcccctgcagactggcaggtgggattggctcccaggtcatttcctctctctctctttctcccaagcctttctccctccacaggaaacagatttttcagggccttccatgcctgccactttgtccgtctctttttttttttttaaagtaatattttttagaaatacatgtaaaataccaagaaataatgtctgcgcctctgccacctctctctcatctcttatttcataaagctggctctttatgttgctttacatgccttaatatatgttttatggagattatacatattatagatctatatatgtaatatatttgtttggatgtctgatcttttcctacagttcctgcccaggcctgtttttctctcccttattttccacatcattcctagcatatcaagaccataccccttgcctttttgatccaaagaaggggagaggaaagacttattttaagacatctattttatgcttttgtttaaaaaaagcaaatctattttcaaattgtgcaatgtctgaatggaattggcaaatgaggtgaggagatggggtaactgcctttaggtcccaaccctgtgcctgtccctctgccacagtggcttccttccatcctattccccagtcacgaaagggctggtccccagagctcacccagaaagcatcttgccgggggcagggcattccctcggaagtcctggcctaaggattttattacactgtctgctcctgatgaccctctgcggttgtcaggcgtgaatcctctggaaggaactgtttgcagttgtatgcacaaaggagacccatgcaggcatgcaccccagatgggctgctagactacccctcttcatcagcctgctggaaagagcagacagcgtaacagcagcctatgccaaacagcactaaggatgtcagtgtacgagacggtgcgaagcccagaggaggcggcttgggatcctctgggccatccctggccctgtagcacagacacatacaagttccttggacttgtcacactccttttcacttgatccctctctggcctgggtcacatttatgacatcccccctctgcaacctttctctctgggggctgtaccaaaggcatggtacctcagtctggtatccagactgtgaaatcagcctctgggccaaggagggtcctacagacaaggtggcatctcaacctcacccaagaaacccccgggactttaccccagcaggctgccactggggcaccgaactaagccagctcagccttccaagctgcttagcctttgtcaaccatcaaagtggggaaagggtctctggccttgcaaggatttgggcaggatggaagtctttgtctaggtctgaaatcaagggcttgggaatctagagcagagctcctggccagcgtttgaagcctggcctcccacctggggcatttactgacaccctgtcgccagcctagaacatcctgctctgaatgaacagagcccagatgggggtccagagctaagtgacccacctggggaagctctgattattcatccagggccttctcaatgagcacattacctccatgatcaataaccaagaggctgcagtcaaatactgctactgtcactttgaagattttctaagggcacaagtggcacacttgctctccggcctttgggagaggcatgttcttgggcagggctggctacggcaagagggaaccaattcctttcccctttaggcaccctctacctggcagctcttaaaactaagaaaaaatatgatatacacacacattatatatatatatatatatacacacacacacacacacacacgtatatctatttatgcacatattggggccaatttgatttgctagtattagacaataaactgtacaaggaaatttattatctcagtgtctttatttagcataaaagtggccttagaagaagggtgaaggttagatagatggaatctctgtcaggggacaaacagctgtagcatccccttagcatctttctagccaatgagccccctccccaggaggagggatggcctgactgaaacaggtgagagtttgcttccccctttcagcagcattctttttagatttaggtactgaagaatcccagtgagttctgcatttgtatcttgcaagtttgtataaacccaatacaggaaataaaatgaatggtttgtaaaaaaaaaaaaaaaaaaaaaaaaaaaaaaaaaaaa

SEQ ID NO: 12087 - DNA, 757 bp, Homo sapiens
agcaggctgacagagaaatttttcattttctttcttgtttgactgtatgcaaacatcaaactaagaatggcaaaaatgaatctctcttcctatatattaatactaactttttctttgttttctcaaggtattttactttcagcatccaagtccataagaaatttagatgatgacatggtatttaatacattcaggttggggaaaggctttcagaaggaagacactgcagaaaaatcagttattgctccttccctggaacaatataaaaatgatgagagcagtttcatgaacgaagaggaaaataaagtttcaaagaacacaggctccaaacataatttcttaaatcatggtctgccactgaatctggctataaaaccttatcttgcactaaaaggatctgtagctttcccagctgagaatggagttcagaatactgaatcaacacaagaaaagagagaaattggggatgaagaaaactcagctaaatttcctataggaaggagagattttgacatgctcagatgtatgctgggaagagtctaccgaccttgttggcaagtctgatacctgttggtccacatcatcttttcagaagaaaataaaagcatttaattgccaatgggaggagaagcccatactgctactataacttgtgtatgttaaatgtctgttttaaaagaaagtagtgttaagatgtatcagtaactgaaatgatatgctttctctgtgcattaaactttgtgaaaattctgcataa

SEQ ID NO: 12088 - DNA, 3579 bp, Homo sapiens
gctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaatagaggtatattgccaaaacatagagccagcttgaaggggctcccactggccaaacttgagccaatctgagagcaaaataattgagaaaaataaataacaagataattgagaaaaaaataaaataaattcccaattccattgggaaaaaatagaaatccatgaatccatactgatataatgatagataatcgatagataggtagatgactgacagatgatagatagatatatagatagatagatagatagatagatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactttgattaagtaaaaaaaatccctattcttggaaaatacacaataaagtattttgaggtaaagggccataatgtatgcaatctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactatgcaaaaaaaaaaaaaaa

SEQ ID NO: 12089 - DNA, 2263 bp, Homo sapiens
aggaagtagggagcggggtggcaggggggggacccgccgcggctgctgccaccgccgccaccaccgcctctgctcgtggcgtgggaaaggaggtgtgagtcccgggcgcgagccgcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtgcttaaagtctcgtgaaatctttctcagtcagcctatcctactagaacttgaagcaccactcaaaatatgtggtgacatccatggacaatactatgatttgctgcgactttttgagtacggtggtttcccaccagaaagcaactacctgtttcttggggactatgtggacaggggaaagcagtcattggagacgatctgcctcttactggcctacaaaataaaatatcctgagaatttttttcttctcagagggaaccatgaatgtgccagcatcaacagaatttatggattttatgatgaatgtaaaagaagatacaacattaaactatggaaaactttcacagactgttttaactgtttaccgatagcagccatcgtggatgagaagatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggatatgaattttttgcaaagaggcagttggtcactctgttttctgcgcccaattattgcggagagtttgacaatgcaggtgccatgatgagtgtggatgaaacactaatgtgttcttttcagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaat

SEQ ID NO: 12090 - DNA, 6272 bp, Homo sapiens
gaagaaactgaggcccggagacacagttaagtgtaggagctaagacctcaacccaggtctctctgactcttaactacttattagcaatcaaggttaataaaagctacctcctgacaaaccagagatggccttacattttatttgtgcatcttgcaggggttttttgttgtttttaattaaagcgctaaatacctttttaacattaaaaatccgaagttgagtatgtccagtatttggaaccgaaccaaattggattttttgctatacagcttactgtacaagtgacctggaacagttgcttagaacctcccacagccacagtttggcaacctgtaaaatgtgcatggtaatatctactttattaagtccatataaaatttaaattagacaaacaagataaaagcacctggcagttagttaacactcaacaataattaatcttccctcccccacctttattaaataattaggcttttccagtttatcttccacatatataccaaagatacgttcataattatgtaagaccaaagggctttttaccttttacagccctgagttcctgagataccccattaagtctgtgtacttatttgcaaatttatattttgtttcttgttttgttttttgttttagtttaacccctatgtgtgccagagtcagtgctgcatagtttgagcctgataggattaactttacaaatgagacatttaagtcacatctgccaagaattatgatttgaatgaaactttaacttacacaggtttttagatttagttagcctaagttatcagctgtctgaagttattcataacctaagtggggcatggccctgaaaaggagggatgagaactgctgatcttagttactctgagaacccactactctgtaatcatacctataaaatcattcgtgtgctggcagccccaaaaggagcataaaccagggactttgatatcatgcagcagaagaccaaattatttctccaagctttgaagtatagtattcctcaccttggaaaatgcatgcagaaacagcatttgaatcactataacttcgctgatcattgttacaatagaataaaattgaaaaaatatcacctaaccaagtgtcttcagaataaacccaagatatcagagttagcaagaaacatcccaagtcggagcttctcatgtaaggatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattcctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcagttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattctcattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtctgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattaaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggccaggcaaggtggctcaggcccgtaatcctagcactttgggaggcaaggcagacagatcaccagaggtcaggagttcaagaccagcctggccaacatggtgaaacaccatctctactaaaaaatacagaaattacccgggcataatgacgtgcacctgtaatcccagctacttgggaggctgcagcaggagaatcacttgaacccaggaagcagaggctgcagtgtgccgagatcacgccactgcactcgagcatgggtgacggagcaagactgtctcaaaaaaaaaaaaaaacagtgttgagatcctttaagtattattgtgcacatgtgcaaatatttctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataattcggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttga

SEQ ID NO: 12091 - DNA, 4529 bp, Homo sapiens
gtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcgtgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaaaaaaaaaaaaaaaaaa

SEQ ID NO: 12092 - DNA, 4499 bp, Homo sapiens
acacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaatgaaagagtttctagccaaagccaaagaagactttttgaaaaaatgggagaatccaactcagaataatgccggacttgaagattttgaaaggaaaaaaacccttggaacaggttcatttggaagagtcatgttggtaaaacacaaagccactgaacagtattatgccatgaagatcttagataagcagaaggttgttaaactgaagcaaatagagcatactttgaatgagaaaagaatattacaggcagtgaattttcctttccttgttcgactggagtatgcttttaaggataattctaatttatacatggttatggaatatgtccctgggggtgaaatgttttcacatctaagaagaattggaaggttcagtgagccccatgcacggttctatgcagctcagatagtgctaacattcgagtacctccattcactagacctcatctacagagatctaaaacctgaaaatctcttaattgaccatcaaggctatatccaggtcacagactttgggtttgccaaaagagttaaaggcagaacttggacattatgtggaactccagagtatttggctccagaaataattctcagcaagggctacaataaggcagtggattggtgggcattaggagtgctaatctatgaaatggcagctggctatcccccattctttgcagaccaaccaattcagatttatgaaaagattgtttctggaaaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaaaaaaaaaaaaaaaaaa

SEQ ID NO: 12093 - DNA, 3750 bp, Homo sapiens
gcgctgctcgccagcttgctcgcactcggctgtgcggcggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcagggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaaaaaaaaaaaaaaaaaa

SEQ ID NO: 12094 - DNA, 1450 bp, Homo sapiens
gatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaaaaaaaaaaaaaaaaa

SEQ ID NO: 12095 - DNA, 1363 bp, Homo sapiens
gatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcagaccagaagccagatgtgatgtacgcggacatcggaggcatggacatccagaagcaggaggtgcgggaggccgtggagctcccgctcacgcatttcgagctctacaagcagatcggcatcgatcccccccgaggcgtcctcatgtatggcccacctggctgtgggaagaccatgttggcaaaggcggtggcacatcacacaacagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacaggggccgacagggaggttcagaggatcctgctggagctgctgaatcagatggatggatttgatcagaatgtcaatgtcaaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactatgtggcccggccagataagatttcaggagctgatattaactccatctgtcaggagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaaaaaaaaaaaaaaaaaaaaaaa

SEQ ID NO: 12096 - DNA, 6825 bp, Homo sapiens
gcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaaaaaaa

SEQ ID NO: 12097 - DNA, 2504 bp, Homo sapiens
ctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaagtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagcttggtgccttttacatcgggtttgttctccttccatggtgtgttgctgacattgtcactgagtcccatgtgaggtgctggtgagtattacctttcatctgtgccatgctctagaaccttgaccttgatagttcaccacgtctgatggatccctgttttaaataaaaacgattcactttaaagcct

SEQ ID NO: 12098 - DNA, 1607 bp, Homo sapiens
ctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggagaagcgcagaccctactctgactccactgcaaagctgaagcggaccctgccctgccaagcctacgtgaaccaaggcgagaacctggagaccgaccagtggccgcagaagctgatcatgcagctgatccctcagcagctgctgaccaccctgggccccctgttccggaactcccagttggcacagttccacttcaccaacagagactgcgactcgctcaaggggctctgccgcatcatgggcaacggcttcgcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggcagtgggacctggtggtgtcaactcaggcccagtccagatcgtcaacaacaagtttctggcatggagtggtgtcatggagtggcaggagcccaggcctgagcccaacagtcggtccaagaggtggctgccatcccacgtctacgtgaaccagggggagatcctgaggaccgagcagtggccaaggaagctgtacatgcagctcatcccgcagcagctgctgaccaccctagtgccgctgttccggaactcgcgcctggtccagttccacttcaccaaggacctggagacactgaagagcctgtgccggatcatggacaatggcttcgccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgagggatgggggggtagtggttaccccgggctgggcccctccaggagtcacagatgaggcccccgcagagactgtgcttgggagcctgtggccagcagcccccactgtacccctgcccccaggtgacacgcttctgagcaggggcccctggggacttcaactgcccagcaacatggaggatggtgtcctgaggcctccaaggacggtccccacccctctacgtttccccaataaagccttttaaaaaccaaaaaaaaaaaaaaaaaaaa

SEQ ID NO: 12099 - DNA, 5395 bp, Homo sapiens
acgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggcgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggtgtagggtgggatggggagggaggctggacatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtgtgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12100 - DNA, 6390 bp, Homo sapiens
cccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacggagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatacaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtggctgtttactggatgaggcagatttttcacatttttgccaattaaatatattttatatatagtaaggttaattttttcagtttttttaatgtaaaagcaagtgaaattttaataaacttctgtaatttcccaaaaaaaaaaaaaaaaaaa

SEQ ID NO: 12101 - DNA, 1116 bp, Homo sapiens
ctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaaaaaaaaaaaaaaaaaaaaaaaaaaaaaa

SEQ ID NO: 12102 - DNA, 4084 bp, Homo sapiens
gaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaaacacaagaaaatagagtgaggcttttttaccgtatatacataaaatacttatgaaaattagaagataatttggcattcctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaattgaagagattattttcctatgtaatttcacattctaatatactaaatgtttatattccttagagaactattttatattgtgcgctgggggcttgtgatgtttgtgtgctgttttaaaattcatttcaaattggactcgatttccttatatctaatatatatctgggagaaaaggctgcttgaaaatatcttttgattcagtgatttttaacattgggaagttgagtttattaaaaggtagtctg

SEQ ID NO: 12103 - DNA, 3570 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactataatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccctgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatctcagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaac

SEQ ID NO: 12104 - DNA, 2327 bp, Homo sapiens
gcgcggggcggggcttccgggcggggcaggctggcttccggcgggagcggggccgcggatggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcgaaaaaaaaaaaaa

SEQ ID NO: 12105 - DNA, 910 bp, Homo sapiens
gcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaaaaaaaaaaaaaaa

SEQ ID NO: 12106 - DNA, 1218 bp, Homo sapiens
agatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcaaaaaaaaaaaaaaaaaa

SEQ ID NO: 12107 - DNA, 3030 bp, Homo sapiens
agccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagcggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgtttttgtttatctcaaaataatgttgaaatacaattatcaatgaaaaaactttcgtttttttttttgtttgttttgtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaatttttttgtatktttagtagagacagggtttcatcatgttggccagactggcctcgaattcctgacctcaggcaatccacccgcctcggcctcccaaagagctgggattacaggcgtgagccaccgcaccctgccgaaaaaaacttttttttttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattcaaaaaaaaaaaaaaa

SEQ ID NO: 12108 - DNA, 3485 bp, Homo sapiens
agtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgtatagactgacatccagttttcttcaactgt

SEQ ID NO: 12109 - DNA, 4357 bp, Homo sapiens
gccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaactttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgaaaaaaaaaaaaaaaaaa

SEQ ID NO: 12110 - DNA, 4241 bp, Homo sapiens
gggatccggcgccttccccggctgtcctcggcctcccgcgcgctccgcgggaggagccgccagcggccgtgacgcgtcaaggaggaaacgccggcgcccggcggccctgccgggaaggaggaagcgcagtgcgttcggctccgcgcccgccgcgccgggagcagcaccgcggggccaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaaaaaaaaaaa

SEQ ID NO: 12111 - DNA, 4155 bp, Homo sapiens
gggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaaaaaaaaaa

SEQ ID NO: 12112 - DNA, 4059 bp, Homo sapiens
gggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaaaaaaaaaa

SEQ ID NO: 12113 - DNA, 3297 bp, Homo sapiens
tgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttcctttggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaacttcgggcaagttaaatgggacagccttccatgttcatttgtctacctcttaactgaataaaaaagcctacagtttttagaaaaaaaaaaaaaaa

SEQ ID NO: 12114 - DNA, 2964 bp, Homo sapiens
gagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgtaaaaaaaaaaaaaaa

SEQ ID NO: 12115 - DNA, 3433 bp, Homo sapiens
ttgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 12116 - DNA, 3293 bp, Homo sapiens
gaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 12117 - DNA, 3264 bp, Homo sapiens
ggccgccaacatgctctgtctgtgcctgtacgtgccggtcatcggggaagcccagaccgagttccagtactttgagtcgaaggggctccctgccgagctgaagtccattttcaagctcagtgtcttcatcccctcccaggaattctccacctaccgccagtggaagcaggtctgtggggtgaccgcgcggaagggagaggcgcgttcaaccgaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 12118 - DNA, 3240 bp, Homo sapiens
ggcagtggagcacccagcaggccgccaacatgctctgtctgtgcctgtacgtgccggtcatcggggaagcccagaccgagttccagtactttgagtcgaaggggctccctgccgagctgaagtccattttcaagctcagtgtcttcatcccctcccaggaattctccacctaccgccagtggaagcagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 12119 - DNA, 3098 bp, Homo sapiens
tgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcaaaaa

SEQ ID NO: 12120 - DNA, 2323 bp, Homo sapiens
gaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaataagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaaccgctttaagaaaggttctcaaatgttttgaaaaaaaaaaaaaaaaaaaaaaaaaaaaaa

SEQ ID NO: 12121 - DNA, 3410 bp, Homo sapiens
gggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgacttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgtttaaaaaaaaaaaaaaaaaaaaaaaaaaaaaaaaaaaaaaaaaaaraaaaaaaaaaaaaaaaaaaaaaaaaaaataaaaaaaaaaaa

SEQ ID NO: 12122 - DNA, 5262 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 12123 - DNA, 5259 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 12124 - DNA, 5250 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 12125 - DNA, 5146 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 12126 - DNA, 5268 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 12127 - DNA, 3592 bp, Homo sapiens
gaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatttcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgacttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaaaaaaaaaaaaaaaaaa

SEQ ID NO: 12128 - DNA, 2146 bp, Homo sapiens
cgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaaaaaaaaaaaaaaaa

SEQ ID NO: 12129 - DNA, 1434 bp, Homo sapiens
ttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgagcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgggatctctacagaatcagaagatgttcctcagctctcaggtgaaactgcgatagaaaaacccgaagagtttggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcagtaaaaaaaaaaaaaaaaaaaaaaaaaaaaaa

SEQ ID NO: 12130 - DNA, 2868 bp, Homo sapiens
cgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaatcgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatttgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaaaaaaaaaaaaaaaaaaaaa

SEQ ID NO: 12131 - DNA, 1165 bp, Homo sapiens
cgcaccatctgcacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgacaaaaaaaaaaaaaaaaaaaaaaaaaaaaaaaaaaaa

SEQ ID NO: 12132 - DNA, 2500 bp, Homo sapiens
cacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgataaactgcttatcaataacagctgtagcactgtggcttttctccatggactcatggtggtctttggaacaacgttcttcaactttgacagcttcatagggaaaacagattctatagaaataattggaaaatcagtttttccctattgttatcacaatatccttccactgctgaatgattctggcaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtatatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtattttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaagttatttctttaattctgtgggagttttgtataattttacttttatggtttttacacatacttgaaacactctttctaaagaattaataaaaacagaaatgagaaacatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12133 - DNA, 3520 bp, Homo sapiens
ctggagcccagccggagcggcggcccctccgcggagcccggtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcctcccggtaggccagctgccgagctgggctatgttctggaacccagtgaatcttgggggccaggcactgtgctaggcaccagcaggggtaacacgaagaagacccggcccttagggcatcaggaagactagctcccctgccccggaggatctgctcagtgctgatggcagcccagctgtgtggactcagggggctctgagggctagggaaacaggaagggcctctttgacaaggtaggagctgtgcttggaggggcaggaaaagaactgagcatgtcgcaggcagcgggcccagcctgagcaatggcaggatgtgaacttccccatcgcaaatgcagttctcagcccactgcagtggatacaaggaagggcctttctcggggccggagaagagaccaagagaccaggcccgggcagcagcctaccggccacgtggaacactggctccggagttattctctgtcaaatctactccccggacctcaaccatggcaagaaccagaggtccaaagaggcccagacccaggtccttgtgctcagtcctgcgcaaaccaggcccagaccctgcaagcatttgttgatgcccttgcaggcccactgggagaaagatgcctcaggcaggtctcagcctgggggtggcaggggtggggcagagagaatactgacagcagaggtcttggtgggctgcacgtgcctgcgaagatgtggtggacaaggaggctctcgggctgggccttggaggggtggcagcggaaggacagcccaggtggctgaggcctgatgggaagccggggaaggccagggtggaagggcggcttgagggacgccaggagaagactgaatgccaggctaggaaggaggcggctctcgatcacggggtgggtgcccccgacaccgggtctcctagcttgagttccctagaagcgaaatctgagagggggattctggggcaagtagtttcttgcgggtgagtgttctcagagaaacttaccagatcaagaaagggagctcaggctggatggaggaagccacgcaagtgtggcttcaagatccatcgccttggcctgatcgctgtgggggcaggggcctggagtacgaggggcaccctgggggctcccacccagaagcagaggggctgggctgttgcacctctactggcatcagtctttggttaccccccagccccagtaggaggagagcaggcagagcttgtcatccccagcctggtgtcccgcagtcccaggaagccgcttcttgccttcatggctgagtgctgggaagggctgagctcacccaggccagcaggtggggtatcatctgctcggtggggccacccacaggtgacagcatggaccctcaggctggctgcccctgttccttggtccataactggtgagctatggagacccaggccaacaaattatccccagtgatatggggggaggaggggctagaacaagggcccaggggactggaggcaggatggtggctttccctacctgacacagccatggcccagccccaaggccaggctgtctaccctatggccacagcaggaggtcagcccagggccaggagacacatggctggacaaggctttgcagcctgggagaccccgactttctctaacccagtggctgtgcggtgcaggccactgactccccccctgccctctcccctctctccctccccctaactgcatgacatgttaactgtgtgcccaggacagccgtggtggggaccgggtatgccaactggaatgattctagaaccaaaataaagttggggcaggaagagggggcttccagggagccctgctcggccctgaatcaccttcgtctcttctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12134 - DNA, 1319 bp, Homo sapiens
cgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaaaaaaaaaaaaaaaaaaaaaaaaaaaaaaaaaaaaaaaaaaaaaa

SEQ ID NO: 12135 - DNA, 1448 bp, Homo sapiens
gcctctccagctgcgacacagatggcgcgcgggctcttgggttctgtagttttctcgcgatccaaaaggctccgtgcccaaagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaaaaaaaaaaaaaaaaaaaaaaaaaaaaaaaaaaaaaaaaaaa

SEQ ID NO: 12136 - DNA, 1888 bp, Homo sapiens
gcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaaaaaaaaaaaaaaaaaa

SEQ ID NO: 12137 - DNA, 1488 bp, Homo sapiens
cccggcgtgcaccggggcagtggctgctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaaaaaaaaaaaaaaaaaaaaaaaaaaaaaaaaaaaaaaaaaaa

SEQ ID NO: 12138 - DNA, 3404 bp, Homo sapiens
agacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactaaggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactc

SEQ ID NO: 12139 - DNA, 6468 bp, Homo sapiens
atgaattattcatcattccttagaatttgggtctctttcatcttcgcacttgtacagcaccaagctcagcccagggagctcatgtatccattttggcagaatgacaccaaaacccctaaagtagatgatggaagctcatctgagattaagttggccatcccagttttcttctttggcgttccttaccgcactgtctatgtcaataacaacggagttgtttccttcaatgtgctagtgagccagttcacgccagaatcctttcccctgacagatgggagagccttcgtcgccccattttgggcagatgtgcacaatggaattcgaggcgagatctattacagagagaccatggagcctgccatcttgaaaagagccaccaaggacatcaggaagtacttcaaagacatggcaaccttctctgccacttgggttttcattgtgacatgggaggaagtcacgttttatggaggcagcagcaccacacctgtgaacaccttccaggccgtcctagtgtccgatggctcctatacattcaccctcttcaattattacgaaatcaactggaccacggggacggcgagtggcggcgaccccctgacaggtcttggtggagtgatggcacaggcaggatttaatggtggaaacctcaccaatttcttcagcctcccggggtcaagaacccccgagatcgtgaatatccaggagaccacaaacgtcaatgttccaggccgctgggcatttaaagttgatggaaaggaaattgacccagccaatggctgcacctcaaggggacaattccttcggcgaggggaggtgttttgggatgacttgaactgcaccgtcaagtgccgctgtctggatttcaacaatgagatctactgccaggaggcttcctgtagcccctacgaggtgtgcgaacccaaaggcaaattcttctactgcagcgctgtggagaccagcacatgcgtggtgtttggggagccacactaccacacttttgacggcttcctcttccacttccaaggctcctgtgcctacttgctggcccgacagtgtttgcagacttccagcctccctttcttcagtgtggaggccaagaatgaacaccgcggaggttcagccgtctcctgggtgaaggagctctcagtggaggtgaatggctacaagattctcatccccaaaggaagctatggaagagtcaaggttaatgacctagtgacttctttgcctgtcaccttagacttggggacagtgaaaatctaccagagtggcatatctactgccgtggaaacagattttgggctcttagtgacttttgatggccagcactacgcctccatttccgtcccaggctcctatataaactccacctgtggactctgtggaaactataataaaaacccactggatgacttcctccgcccggatggcaggccggccatgtctgtcctggatctgggagagagctggcgtgtgtaccacgcggactggaagtgcgactccggctgcgtcgacaactgcacccagtgcgacgctgccactgaagccctctactttggctctgactactgcggcttcctcaacaagacagacggccctctgtgggagtgtggcactgtcgtggaccccactgcttttgtgcacagctgcgtgtatgacctgtgcagtgtgagggacaatggcacgctcctctgccaagccatccaggcctatgctcttgtgtgccaagcccttggcattccaattggagactggcgaacccagactgggtgtgtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgccactgcctactaccgcacctgccttttccgcctgtgccagagtgggggcaatgagtcagagctctgtgactctgtggcccggtatgcaagcgcctgcaagaatgcggacgtggaggtggggccctggcggacctatgacttctgcccactggagtgcccagagaacagccactttgaggagtgcatcacatgtacagagacctgtgagacccttaccctgggccccatctgcgtggatagctgctctgagggatgtcagtgtgatgagggctatgctctactgggcagccagtgtgtcacgcggagtgagtgtggctgcaactttgaggggcaccaacttgccaccaatgagaccttctgggtggacctggactgccagatcttctgctattgcagtggcacagacaacagggtccactgcgagaccattccctgcaaggatgatgagtactgcatggaggaaggtggcctgtactactgccaagcccgcaccgacgcctcctgcatcgtctcaggctacggccactacctcacctttgatggcttcccctttgacttccagaccagctgcccactcatcctgtgcaccacaggaagcaggccaagctcagactctttccccaagtttgttgtcacagccaagaatgaggaccgggacccgtcactggccttgtgggttaagcaggtggacgtgaccgtgtttggctacagcatcgtgatccaccgagcttacaagcacactgtgctggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcactgtcacctgccctccaaacagccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgagcccaagcagctattttggaacagcgactgcacgcggcgctgccgctgtttccgtcgcaacgtgattcagtgcgacccgcgccaatgcaagtcagacgaggagtgtgcgctgcgcaacggggtgcgcggctgcttcagcaccaagacctcctactgcctggcggccggcggcggcgtcttccgcaccttcgacggcgccttcctgcgcttcccagccaactgcgccttcgtgctgtccaccatctgccagaaactgcccgacatctccttccagcttatcatcaacttcgacaagtggtcggcccccaacctcaccatcatttcgcccgtctacttctacattaacgaagagcagattctcatcaacgaccggaacacggtcaaggtgaatggcacacaagtgaatgttccatttataactggtttggcaaccaaaatctacagcagtgaggggtttctggtgattgacaccagcccagacatccagatatactacaatggtttcaacgtcattaaaatcagcatcagcgagaggctgcagaacaaagtgtgcggtctctgtggcaacttcaacggggacctaacagatgattatgtgaccttgcgagggaagccggtggtaagcagcgtggtgctggcccagagctggaaaaccaatggcatgcagaagagacctcttgcccccagctgcaacgagctgcagttctcacagtatgcagccatgtgtgacaatgtgcacatccagaagatgcagggtgatggctactgcctgaagctcaccgacatgaagggcttcttccagccctgctatgggcttctcgatcccctcccattctacgagtcctgctacctggacggctgctacaaccacaagaagttccagctgtgcggctccctggccgcctacggggaggcctgccgctccttcgggatccttagcaccgagtggattgagaaggagaattgctcaggagtggttgaagatccctgtgtgggggcggactgtcccaaccgaacttgcgagctgggcaatggcagggagctgtgtggctgcatcgagccacccccctatggaaataactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcagtccaatggcacgcatatcatgtataaaaacacactctggatcgaaagcgccaacaacactggcaacatcatcaccagggaccgcacgatcaatgtggaattttcatgtgcttatgagctggatatcaagatctccttggattctgttgtgaagcctatgctaagtgtaattaacctgacagttccaacccaagaaggcagcttcatcaccaagatggctctctacaaaaacgcctcctacaaacatccttaccgccagggtgaagtagtgttgacgactcgagatgtgctgtatgtaggggtttttgtggttggagctgacgccacacatttaatcctaacactcaacaaatgctatgccacacccacccgagatagcaatgataagctccgatatttcatcattgaaggagggtgtcagaacctcaaagataacaccattggcatcgaggagaatgcagtctccctgacctgtcgctttcacgtcaccgtctttaaattcataggggattacgacgaagttcaccttcactgtgcagtgtcactctgcgactcagaaaagtactcctgtaaaatcacttgcccacacaattccaggattgccacagattacacaaaagagcccaaagaacagatcatttcagtgggacctattaggagaaaaaggctggactggtgtgaggacaatggagggtgtgagcagatttgcacgagccgggtggatgggcctctctgcagctgtgtaacaggaaccctgcaggaggacggcaagagctgcagagcctctaattcttcaatggaacttcaagtctggacgcttcttctcatcatgatccagatttcattatggcattttgtctataaatcaggcacgacctcataa

SEQ ID NO: 12140 - DNA, 1977 bp, Homo sapiens
gcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggcaaaaaaaaaaaaaaaaaaaaa

SEQ ID NO: 12141 - DNA, 2038 bp, Homo sapiens
atggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaacctcgtggccattctagacatcaatcgcctgggccagagtgacccggcccctctgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacattaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaaaaaaaaaaaaaaaaaaaaaaaaaaaaaaaaaaaaaaaaaaaaaaaaaaaaaaaaaaaa

SEQ ID NO: 12142 - DNA, 7578 bp, Homo sapiens
tacgggaaatgtttggtgcagcatccagaatggacaccactgctgtctgcaccgggggagtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatggacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaaggtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattc

SEQ ID NO: 12143 - DNA, 1451 bp, Homo sapiens
actgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagct

SEQ ID NO: 12144 - DNA, 1726 bp, Homo sapiens
agcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctacccagcttctgaattcttacttgggtaccaccctgcggacaatggaagatgtcattgcagaacagagtgttagtggatattttgtgttttgtttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagctttcatccctacccttggggggaactgaaatggctccttaaaaataaactggttttatttttccacctggggtaaaatatggccacaagccaaaaacacggcaaaatattatttttggggtgggaatgggctcaacctcccaaaaaattgggggaaacctcccttgggttctcct

SEQ ID NO: 12145 - DNA, 2317 bp, Homo sapiens
aaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaat

SEQ ID NO: 12146 - DNA, 4083 bp, Homo sapiens
atggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 12147 - DNA, 2467 bp, Homo sapiens
aaaaaatcacccggatggcggctgcgacgcgcggctgccggccctggggctcgctcctcgggctgctcgggctggtctcggccgcggccgccgcctgggacctggcttccctgcgctgcaccttgggcgccttttgcgaatgcgacttccggcccgacttgccgggtctggagtgtgacctggctcagcacctggccggccagcatctggccaaggcgctggtggtgaaggcgctgaaggcctttgtgcgggacccagcccccaccaagccgctggtcctctccctgcacggctggaccggcaccggcaaatcctatgtcagctccctgctggcgcactacctcttccagggcggcctccgcagcccccgcgtgcaccacttttctcccgtcctccacttcccccaccccagccacatcgagcgctacaagaaggatctgaagagctgggtccaagggaacctcactgcctgtggccgctccctcttcctcttcgatgagatggacaagatgcccccaggcctgatggaagtcctgcggcctttcctgggctcctcctgggtggtatacgggaccaattaccgcaaagccatcttcatcttcatcaggtggggcccggctttgcagtgggcacagtgcgggggccacttctcagaggttcagctctacagccttagcctgtgctcccagcagaatccagttccccatgggcttagctgggctttcccagtgccctccgccactctcagagatgacattgtcattccgcctggttgatttccctttggacattctcagcaaattctgggctcagtctttttgatcgccacttctttgtggaagccctgccaggtcaagaagttttccctcttttgtggtgaggaggacacaggcctgggaaaaataggaacagagttcttgtcctttagtcccagctctcagaatcctcgctgtgtttcctcaggcagcatggctccgcctctctgagcctctgtctctgcttctgaacagcggggccaataatgatgccccgatgccttcctggaagttcagtgagggaaagtcagttgagggacacaaaagtgttttgtaaactataaagtacgtggcatgtgtaggtgaattacaggggccatggatgtggacaccatggagggggaagtggagcgttttcagtggagttggctcctccccgcactgagccatgttcctatgtcaggtggcagcggggaagcgagggtccaatcctgccctgcgctagtcctcatctgagtctcagcctgggtcccccatggttttagcaacacgggtggcgagcagatcaaccaggtggcattggaggcgtggcgcagccggcgggaccgcgaggagatcctcctgcaggagctggagccggtcatctcccgcgcggtgctggacaacccgcaccgtgagtctggctcagcagccccctcccgggcggcttcaccccacacccaggggccaggctctcccggggtctcatgctttgcccactgacccggcagttctgagcctggctttggcactcccagctttgtgactttgggtgagccttacagcccctgagtcctacacccagaaggtggctgagggaactgaggccagcatttttcctcctgcccctgggggtttggggccggcttctcccctcttgtgaagcacaaagtcccctccccacctacccttcctgcagatggcttctcaaactcgggcatcatggaagagcgcctcctagacgcagtggtgcccttcctcccgctccagcggcaccacgtccggcactgcgtgctcaacgagctggcccagctgggcctggagccaagggatgaggttgtccaggctgtgctggacagcaccaccttcttccctgaagacgagcagctcttctcctccaacggctgcaagaccgtggcctcccgaatcgccttcttcctctgactctctgagtggtgtcctcggcccccctgatggccaggccatgcaggaaaggccaggggcctctgtcacaggaacccagagcaccaagtgagatgaacggagtgtcggctaggccacgggacagatggccaggaagggccctggcctctaaactggctcgagagcatcttggccccggccaccttccccagggaaacccctggtcaccccagaacctcactgagccttgacctccccctgcagcctgagccttcttactgtgaattataactcagggactgtggctcgtggcggtgctccctcctcagtctgccacccttgccccttgcctccttggtcgggcaccatacctcctcccctccaccccacaccctgtgtccatatcaagccaggtggagccttctcagtttccagaaatggagggactcatgctgccacttgggcctggttttagatgtttttaattttgtaaaagaaaacaagtataataaactcagctgtgggaccag

SEQ ID NO: 12148 - DNA, 4124 bp, Homo sapiens
gcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccagggaatctctggagattggttcaccttttgtggtcctgaccccttctgtcctcactgtaccttgaagtcctagagtccaataaaatcgctgcctcccagctgtttggatcacagagaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccggacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaaggggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagc

SEQ ID NO: 12149 - DNA, 3908 bp, Homo sapiens
ccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcatgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 12150 - DNA, 5360 bp, Homo sapiens
cacggcgacggcggcggtggcggcagttcctgctctaggctgcgagcggctggcggcttcgaggggagctgaggcgcggaggggctcggcggcagcggcggcggctcggcactgttacctctcggtccggctggcgccggggcgcgcggtttggtcctttccgggcgcgcgggggcgacagcggcagcgacccgaggcctgcggcctaggcctcagcgcggcggcgggctcgagtgcagcgcggaaccggcccgagggccctacccggaggcaccatgagcgtggaggcgtacgggcccagctcgcagactctcactttcctggacacggaggaggccgagctgcttggcgccgacacacagggctccgagttcgagttcaccgactttactcttcctagccagacgcagacgccccccggcggccccggcggcccgggcggtggcggcgcgggaggcccgggcggcgcgggcgcgggcgctgcggcgggacagctcgacgcgcaggttgggcccgaaggcatcctgcagaacggggctgtggacgacagtgtagccaagaccagccagttgttggctgagttgaacttcgaggaagatgaagaagacacctattacacgaaggacctccccatacacgcctgcagttactgtggaatacacgatcctgcctgcgtggtttactgtaataccagcaagaagtggttctgcaacggacgtggaaatacttctggcagccacattgtaaatcaccttgtgagggcaaaatgcaaagaggtgaccctgcacaaggacgggcccctgggggagacagtcctggagtgctacaactgcggctgtcgcaacgtcttcctcctcggcttcatcccggccaaagctgactcagtggtggtgctgctgtgcaggcagccctgtgccagccagagcagcctcaaggacatcaactgggacagctcgcagtggcagccgctgatccaggaccgctgcttcctgtcctggctggtcaagatcccctccgagcaggagcagctgcgggcacgccagatcacggcacagcagatcaacaagctggaggagctgtggaaggaaaacccttctgccacgctggaggacctggagaagccgggggtggacgaggagccgcagcatgtcctcctgcggtacgaggacgcctaccagtaccagaacatattcgggcccctggtcaagctggaggccgactacgacaagaagctgaaggagtcccagactcaagataacatcactgtcaggtgggacctgggccttaacaagaagagaatcgcctacttcactttgcccaagactgactctgacatgcggctcatgcagggggatgagatatgcctgcggtacaaaggggaccttgcgcccctgtggaaagggatcggccacgtcatcaaggtccctgataattatggcgatgagatcgccattgagctgcggagcagcgtgggtgcacctgtggaggtgactcacaacttccaggtggattttgtgtggaagtcgacctcctttgacaggatgcagagcgcattgaaaacgtttgccgtggatgagacctcggtgtctggctacatctaccacaagctgttgggccacgaggtggaggacgtaatcatcaagtgccagctgcccaagcgcttcacggcgcagggcctccccgacctcaaccactcccaggtttatgccgtgaagactgtgctgcaaagaccactgagcctgatccagggcccgccaggcacggggaagacggtgacgtcggccaccatcgtctaccacctggcccggcaaggcaacgggccggtgctggtgtgtgctccgagcaacatcgccgtggaccagctaacggagaagatccaccagacggggctaaaggtcgtgcgcctctgcgccaagagccgtgaggccatcgactccccggtgtcttttctggccctgcacaaccagatcaggaacatggacagcatgcctgagctgcagaagctgcagcagctgaaagacgagactggggagctgtcgtctgccgacgagaagcggtaccgggccttgaagcgcaccgcagagagagagctgctgatgaacgcagatgtcatctgctgcacatgtgtgggcgccggtgacccgaggctggccaagatgcagttccgctccattttaatcgacgaaagcacccaggccaccgagccggagtgcatggttcccgtggtcctcggggccaagcagctgatccttgtaggcgaccactgccagctgggcccagtggtgatgtgcaagaaggcggccaaggccgggctgtcacagtcgctcttcgagcgcctggtggtgctgggcatccggcccatccgcctgcaggtccagtaccggatgcaccctgcactcagcgccttcccatccaacatcttctacgagggctccctccagaatggtgtcactgcagcggatcgtgtgaagaagggatttgacttccagtggccccaacccgataaaccgatgttcttctacgtgacccagggccaagaggagattgccagctcgggcacctcctacctgaacaggaccgaggctgcgaacgtggagaagatcaccacgaagttgctgaaggcaggcgccaagccggaccagattggcatcatcacgccctacgagggccagcgctcctacctggtgcagtacatgcagttcagcggctccctgcacaccaagctctaccaggaggtggagatcgccagtgtggacgcctttcagggacgcgagaaggacttcatcatcctgtcctgtgtgcgggccaacgagcaccaaggcattggctttttaaatgaccccaggcgtctgaacgtggccctgaccagagcaaggtatggcgtcatcattgtgggcaacccgaaggcactatcaaagcagccgctctggaaccacctgctgaactactataaggagcagaaggtgctggtggaggggccgctcaacaacctgcgtgagagcctcatgcagttcagcaagccacggaagctggtcaacactatcaacccgggagcccgcttcatgaccacagccatgtatgatgcccgggaggccatcatcccaggctccgtctatgatcggagcagccagggccggccttccagcatgtacttccagacccatgaccagattggcatgatcagtgccggccctagccacgtggctgccatgaacattcccatccccttcaacctggtcatgccacccatgccaccgcctggctattttggacaagccaacgggcctgctgcagggcgaggcaccccgaaaggcaagactggtcgtgggggacgccagaagaaccgctttgggcttcctggacccagccagactaacctccccaacagccaagccagccaggatgtggcgtcacagcccttctctcagggcgccctgacgcagggctacatctccatgagccagccttcccagatgagccagcccggcctctcccagccggagctgtcccaggacagttaccttggtgacgagtttaaatcacaaatcgacgtggcgctctcacaggactccacgtaccagggagagcgggcttaccagcatggcggggtgacggggctgtcccagtattaaaaggtggcggcggaagagctaagcaacgtggcttagtccatcagcatcttattctgggtaataaaaaataaaaataaacggatacctgttttccactgctaaaactgaagcaccactgtgtgagcaacaggaagggagagcgcacgagggagaggagccgaggccgagcgccccctgctggcccgcggcggcgaggagcagagggagcggaggaggggccggcccgcgggagccgcggccaccaggaggccccgctccgtcccatcggggctgcggccagggcggagggaggaagaccctcatctcagagtagccctttcctctgttcttttatttctttttctctttgattgaaaggggactacgtcttagcaggaaaaaaaacttcgcatttctgtgcccgagcaggctccttgcaaagacagcagcgtgcggggcagagccccgggagggcgcgtctgtccacgcctaccggacgcgccgaggtcgcgctgcctgtgttctccgagggccttcatttaaagaaaataagggtgttttgggtttttctctttgtttttttcaagattcttttaaaggagtactgaagaatactttcctaagtttgtctgtaaaatcttagcggtggacctgggagatttgagaagcttccagaaacagtttaaacaagccagcgctactggagaagaggagcaacacctgtgccgcggccggaggagttttgttgttggttttagcttccagtggcttctttctgcggggcatcaggctgctggggtagccgcccgccgagcctggaagctgctcgttctccgctggactcagaagccaagctgcttcccgcctagactcggcgcagggccccgcaccggtgaggaaggtgcttttggccccattgcgaggggccttggccaggactggccctgtggccaggaggcgagaaggtggctgttcccggattgacggctttttcccgggggcctttggaagatttggtggaaggacaagagggcctgtccctgtccccgtccccaggaggtaccgacagtccctgtgctggttagacacggagcgctgcacaccgaaagcccaaattgggagctctgcctgccggcaactttgctgatggggtgattgctgcttctggggggtaaggaaacaagttacagaaattaccgcgttctgtgtgaagggactgagggtgtggtgtcattggcagagggtcattttaggagagctgccccagcccctcgaacgcctggcttggggtgtcattctgcctggcggccaggcctccagcttcccctgccccgggcctggggctgtcactggccctgatccgaacacctccagattccggcttctacatgggacagacggggacgcacaggccaccttccttctggcagggactcttatttattcccattgctctagggctttcggtttccccttcttccggtaggccgcgtagaggcatgcaccgggtaggtttccgcggtgaccccgcggcggcctgagggacgctccctgccccatcccggctgttgggctgggccgctttgcctctgcttcgccctgtgctgtgttctccagctttgtagcagcagccttgacaaacccaggcgcactgtaccaaggcaatgtaacttttgattttcggtcaatttaagttcttttgtcaccaaatattaataaacagttttgacttcaaaaaaaaaaaaaaaa

SEQ ID NO: 12151 - DNA, 2209 bp, Homo sapiens
ggcggctggaggcctgagttgggctcgcggcgggggtcggcagggggccgggtggcggaatgatggaggaggaggaactggagttcgtggaggagctggaagccgtgctgcagctcacgcccgaggtgcagctggccatcgagcaggtgtttccaagccaggaccctctagatcgagcagatttcaatgctgttgagtatatcaataccctgttcccaaccgagcaatctctggcgaacatagacgaagtcgtgaacaaaattaggctgaaaataaggagactggatgacaatattcgaactgttgtaagaggtcagacgaacgtggggcaggatggacggcaagtgaaagaaatcacccgtgatattaagcaattagatcacgccaaacgccacctgaccacctcaatcaccacactgaaccacctgcacatgctggcaggaggtgtcgactccctcgaagccatgaccaggcgaagacaatacggagaagttgctaatctccttcagggtgtgatgaatgtcctggagcacttccacaagtatatggggattccgcagatccggcagctttccgaaagagtgaaggctgcacagactgagttaggacagcaaatcctggcagattttgaagaagcgtttccttcccagggcaccaagagaccaggaggacccagcaatgttctacgagatgcatgtctggttgctaatattctagatcccaggatcaaacaggaaatcatcaaaaagtttattaaacagcatctgtcagagtatctggtactttttcaagaaaaccaagatgttgcctggctggacaaaatcgacagacgctatgcctggataaaacgccagcttgtggactatgaggagaaatacggccgcatgtttccacgtgagtggtgcatggctgagaggattgcggtggaattttgccatgtgacaagggcagaacttgccaagattatgcgtaccagagcgaaggaaattgaagtgaaattgcttctttttgctattcaaagaacaactaactttgaggggtttcttgcaaaacgcttctccggctgcaccctgaccgatgggaccctgaaaaagcttgagtctccacccccatctaccaatcccttcctggaagatgagccaacaccagagatggaggaactggcaacggagaaaggagatttagatcaaccaaagaagcctaaagccccagacaatccatttcatggcattgtttccaagtgttttgagcctcatctctacgtgtatatcgaatcccaagacaagaacctcggagagctgatagatcggtttgtggctgatttcaaagcccaggggccacctaagcccaacactgatgaagggggtgccgtgctccccagctgcgccgacctctttgtctactacaagaagtgcatggtgcaatgctctcagctcagtactggggagcccatgatcgccctgaccaccattttccagaagtacctccgagaatatgcctggaaaatcctctctggcaacctgcccaaaaccacaaccagcagtggaggactgactatcagcagcctcctcaaggaaaaggagggctcagaagtagccaagttcactctggaggagctctgcctcatctgtaacatcctgagcacggcagagtactgtctggccaccacccagcagctagaagaaaaactcaaagaaaaagtggatgtaagtctgattgaacgaatcaatctgactggagagatggacacgttcagcaccgtcatctccagcagtattcagctgctggttcaggatctggatgctgcctgtgatcctgccctgactgccatgagcaagatgcagtggcagaacgtggagcacgttggtgaccagagcccctacgtcacctctgtcattctgcacatcaagcagaacgtccccatcatccgtgacaacctggcttccacacgcaagtacttcactcagttctgcgttaaatttgcaaactccttcattcccaaattcatcacccacctcttcaagtgcaagccaattagcatggtgggagcagaacaggtgagatggacgtagtatcaggcatttgcctggcagcttttgttgtagatcaagcacatattcttctagtccagatctacttggcaggaataaaattgatgatgtcccctgtttggggacagtataatgactcaaaaaaaaaaaaaaaaaaa

SEQ ID NO: 12152 - DNA, 866 bp, Homo sapiens
gcttctcccagccggagtaggtgggggaggccagacatggaggcccttcctccagtcagatccagccttttggggaacctgttgcaggttacgaggctctcagtgctgttggttcagaaccgagatcacctctataatttcctgctcctcaagatcaacctcttcaaccactgggtgtcagggctggcccaggaggcccgggggtcctgtaactggcaggcccacctacccctgggagctgcagactgccccctgggccaggctctccgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacttggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctacaaaaaaaaaaaaaaaa

SEQ ID NO: 12153 - DNA, 5525 bp, Homo sapiens
ggggacggtgggagcagatccatttccgggttggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggagcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaggataactttaaccgaaggaagggtttggttccattcaactccacattcattg

SEQ ID NO: 12154 - DNA, 1439 bp, Homo sapiens
ggctcgcctcggcgtgcagtgcgcgtgcgtggagctgggagctaggtcctcggagtgggccggagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctgaaaaaaaaaaaaaaaaaaaaaaa

SEQ ID NO: 12155 - DNA, 7190 bp, Homo sapiens
cttttagtttctcttctttctaaagaaggctcgcggagcccggctggagaacctcaccctcgccgagcctagaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgtgcgcccacgggggccgcatggccctggacgcgctgctccaggagatcgcgctgtctgagccgcagctctgtgaggtgctgcaggtggccgggcccgaccgctttgtggtgttggagaccggcggcgaggccgggatcacccgatcggtggtggccaccactcgagcccgggtctgccgtcgcaagtactgccagagaccctgcgataacctgcatctctgcaaactcaacttgctgggccggtgcaactattcgcagtccgagcggaatttatgcaaatattctcatgaggttctctcagaagagaacttcaaagtcctgaaaaatcacgaactctctggactgaacaaagaggaattagcagtgctcctcctccaaagtgatcctttttttatgcccgagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagagctccttcttcacatcgtagaaacatggcatatagggctagaagcaagagtagagatcggttctttcagggcagccaagaatttcttgcgtctgcttcagcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccacctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatcagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtatttttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcatcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaaaaaaaaaaaaaaaaaaaaa

SEQ ID NO: 12156 - DNA, 2821 bp, Homo sapiens
gaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggaaaaaaaaaaaaaaaaaaaaaaaaaaaaaaaaaaa

SEQ ID NO: 12157 - DNA, 2774 bp, Homo sapiens
gaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggaaaaaaaaaaaaaaaaaaaaaaaaaaaaaaaaa

SEQ ID NO: 12158 - DNA, 2185 bp, Homo sapiens
ggggacttccggtctggctcctaacaacgggggaggctggtaaccagggtgggggggatggcggagcgggcgctagagcccgaggcggaggcggaggctgaggcgggcgcgggcggggaggcagcagccgaggagggcgcagcgggccgaaaggcgcggggccggccgcgactcacggagtcggaccgggcccggcgacggctcgagtcccggaagaggtacgacgtgcggcgcgtgtacctgggcgaggcgcacgggccctgggtggacctgcggcgccgcagcggctggagcgacgccaagctcgccgcctacctcatctctctggagcgcggccagcggagcggccgccacgggaagccttgggagcaggtccccaaaaagccaaagcggaagaaaaggcggcgacgcaacgtgaactgcctgaagaacgtggtgatctggtacgaggaccacaagcaccgctgcccgtacgagccgcacctggcggagctagaccccacttttggcctgtacaccacggccgtgtggcagtgcgaagctggccaccgctacttccaggacctgcattcgcccctgaagcccctcagcgactcagaccctgacagtgacaaagtgggcaatgggctggtggctggcagctctgactcatccagctctggctctgcctctgactctgaggagtctcctgagggccagccggtcaaggctgcggcagcggcagcggcagcgacgcccaccagcccggtgggcagcagcgggctcatcactcaggagggcgtgcacattccctttgacgtccaccacgtggaaagcctggccgagcagggtaccccgctgtgctccaacccagcaggcaatgggcctgaagccctggagacagtggtgtgcgtgccggtgcctgtgcaagtgggtgcgggccccagcgccctctttgagaacgtgccccaggaggccctgggtgaggtggtggccagctgccccatgccaggcatggtgcccggctcacaggtgatcatcattgcgggccctggttacgacgctctcacggccgagggcattcacctcaacatggcagcaggcagcggtgtccccggcagtggactgggcgaggaggtgccctgtgccatgatggagggtgtggcagcctacacccagacagagcccgagggtagccagcctagcaccatggacgccaccgcagtagcaggcatcgagaccaagaaagagaaggaggacctgtgcttgctaaagaaggaggagaaggaggagccagtagccccggagctggcaacaacggtgcctgagagcgcagagcctgaggcagaggcggacggggaggagctggacggcagcgacatgtcagccatcatctatgaaatccccaaggagcctgagaagaggcggcggagcaagcggtcgcgggtgatggatgctgacggcctgctcgagatgttccactgcccatacgagggctgcagccaagtctacgtggccctcagcagcttccagaaccacgtcaatcttgtgcatcggaaaggaaagaccaaagtgtgccctcatcctggctgtggcaagaagttctatttatccaaccacctgcggcggcacatgatcatccattcaggtgtccgtgaattcacctgcgagacctgcggcaagtccttcaagaggaagaaccacctggaggtacatcggcgcacccacaccggcgagacccccctgcagtgcgagatctgtggctaccagtgccggcagcgcgcgtcgctcaactggcacatgaagaagcacactgcggaggtgcagtacaacttcacgtgcgatcgctgcgggaagcgcttcgagaagctggacagcgtcaagttccacacgctcaaaagccacccggatcacaagcccacctgacccacctgaccactgaccgcccctatttattcgtccgctcggacaccacgcccgggcttgccggggcctggacagctgcgagggccgcccggaccgcgggccggaaggaggcgcccccgccccgccccagagctgggccccctgggcaggttccccaccccgccccaccgcatccttctcggagctggtgcctggggctgcattgctggaactgtgtcaagagagcagagtgagattaaagagcgagaaagcaaaaaaaaaaaaaaaaaaaaaaaaaaaa

SEQ ID NO: 12159 - DNA, 951 bp, Homo sapiens
ccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgaaacagcttcctgcgtacatggctgccctgtgtgattccagttgcagcctcacctcctttgcctctctgaaccaaagaagccagccctgcttaccccagttcccaaacacaggaagtgattttctgcctgagctttctgagttctgttccctcccaccccagggctctccatgcttattcattgcatttccttcctcattgcttttacccagtctgctgttttgggaagccctgacatgtattttggtgcctacatattttatcttctgatctcactgaaaataaaattggattttacttgtaaaaaaaaaaaaaaaaa

SEQ ID NO: 12160 - protein, 1130 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 12161 - protein, 1149 aa, Homo sapiens
MGQQPGKVLGDQRRPSLPALHFIKGAGKKESSRHGGPHCNVFVEHEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 12162 - protein, 397 aa, Homo sapiens
MRLLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLTVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 12163 - protein, 513 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 12164 - protein, 674 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 12165 - protein, 706 aa, Homo sapiens
MSSDASQGVITTPPPPSMPHKERYFDRINENDPEYIRERNMSPDLRQDFNMMEQRKRVTQILQSPAFREDLECLIQEQMKKGHNPTGLLALQQIADYIMANSFSGFSSPPLSLGMVTPINDLPGADTSSYVKGEKLTRCKLASLYRLVDLFGWAHLANTYISVRISKEQDHIIIIPRGLSFSEATASNLVKVNIIGEVVDQGSTNLKIDHTGFSPHAAIYSTRPDVKCVIHIHTLATAAVSSMKCGILPISQESLLLGDVAYYDYQGSLEEQEERIQLQKVLGPSCKVLVLRNHGVVALGETLEEAFHYIFNVQLACEIQVQALAGAGGVDNLHVLDFQKYKAFTYTVAASGGGGVNMGSHQKWKVGEIEFEGLMRTLDNLGYRTGYAYRHPLIREKPRHKSDVEIPATVTAFSFEDDTVPLSPLKYMAQRQQREKTRWLNSPNTYMKVNVPEESRNGETSPRTKITWMKAEDSSKVSGGTPIKIEDPNQFVPLNTNPNEVLEKRNKIREQNRYDLKTAGPQSQLLAGIVVDKPPSTMQFEDDDHGPPAPPNPFSHLTEGELEEYKRTIERKQQGLEDAEQELLSDDASSVSQIQSQTQSPQNVPEKLEENHELFSKSFISMEVPVMVVNGKDDMHDVEDELAKRVSRLSTSTTIENIEITIKSPEKIEEVLSPEGSPSKSPSKKKKKFRTPSFLKKNKKKEKVEA

SEQ ID NO: 12166 - protein, 674 aa, Homo sapiens; identical to SEQ ID NO: 12164

SEQ ID NO: 12167 - protein, 1196 aa, Homo sapiens
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVVALYDYTANRSDELTIHRGDIIRVFFKDNEDWWYGSIGKGQEGYFPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 12168 - protein, 535 aa, Homo sapiens
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 12169 - protein, 548 aa, Homo sapiens
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAEVNQGFLLDLDPLLLASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 12170 - protein, 695 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 12171 - protein, 653 aa, Homo sapiens
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 12172 - protein, 1872 aa, Homo sapiens
MMNEDAAQKSDSGEKFNGSSQRRKRPKKSDSNASFLRAARAGNLDKVVEYLKGGIDINTCNQNGLNALHLAAKEGHVGLVQELLGRGSSVDSATKKGNTALHIASLAGQAEVVKVLVKEGANINAQSQNGFTPLYMAAQENHIDVVKYLLENGANQSTATEDGFTPLAVALQQGHNQAVAILLENDTKGKVRLPALHIAARKDDTKSAALLLQNDHNADVQSKMMVNRTTESGFTPLHIAAHYGNVNVATLLLNRGAAVDFTARNGITPLHVASKRGNTNMVKLLLDRGGQIDAKTRDGLTPLHCAARSGHDQVVELLLERGAPLLARTKNGLSPLHMAAQGDHVECVKHLLQHKAPVDDVTLDYLTALHVAAHCGHYRVTKLLLDKRANPNARALNGFTPLHIACKKNRIKVMELLVKYGASIQAITESGLTPIHVAAFMGHLNIVLLLLQNGASPDVTNIRGETALHMAARAGQVEVVRCLLRNGALVDARAREEQTPLHIASRLGKTEIVQLLLQHMAHPDAATTNGYTPLHISAREGQVDVASVLLEAGAAHSLATKKGFTPLHVAAKYGSLDVAKLLLQRRAAADSAGKNGLTPLHVAAHYDNQKVALLLLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETMTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLVSFMVDARGGAMRGCRHNGLRIIIPPRKCTAPTRVTCRLVKRHRLATMPPMVEGEGLASRLIEVGPSGAQFLGKLHLPTAPPPLNEGESLVSRILQLGPPGTKFLGPVIVEIPHFAALRGKERELVVLRSENGDSWKEHFCDYTEDELNEILNGMDEVLDSPEDLEKKRICRIITRDFPQYFAVVSRIKQDSNLIGPEGGVLSSTVVPQVQAVFPEGALTKRIRVGLQAQPMHSELVKKILGNKATFSPIVTLEPRRRKFHKPITMTIPVPKASSDVMLNGFGGDAPTLRLLCSITGGTTPAQWEDITGTTPLTFVNECVSFTTNVSARFWLIDCRQIQESVTFASQVYREIICVPYMAKFVVFAKSHDPIEARLRCFCMTDDKVDKTLEQQENFAEVARSRDVEVLEGKPIYVDCFGNLVPLTKSGQHHIFSFFAFKENRLPLFVKVRDTTQEPCGRLSFMKEPKSTRGLVHQAICNLNITLPIYTKESESDQEQEEEIDMTSEKNPQDEQERIEERLAYIADHLGFSWTELARELDFTEEQIHQIRIENPNSLQDQSHALLKYWLERDGKHATDTNLVECLTKINRMDIVHLMETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 12173 - protein, 498 aa, Homo sapiens
MEDGKRERWPTLMERLCSDGFAFPQYPIKPYHLKRIHRAVLHGNLEKLKYLLLTYYDANKRDRKERTALHLACATGQPEMVHLLVSRRCELNLCDREDRTPLIKAVQLRQEACATLLLQNGANPNITDFFGRTALHYAVYNEDTSMIEKLLSHGTNIEECSKCEYQPLLFAVSRRKVKMVEFLLKKKANVNAIDYLGRSALIHAVTLGEKDIVILLLQHNIDVLSRDAFRKIAGDYAIEAKNRVIFDLIYEYERKRYEDLPINSNPVSSQKQPALKATSGKEDSISNIATEIKDGQKSGTVSSQKQPALKDTSDKDDSVSNTATEIKDEQKSGTVLPAVEQCLNRSLYRPDAVAQPVTENEFSLESEIISKLYIPKRKIISPRSIKDVLPPIEEAVDRCLYLLDRFAQPVTKDKFALESENISEPYFTNRRTISQQSAENLDAACGIDKTENGNMFEDQNVDKEGKALPATGQKANVSPEQPPLFTNLLSDLLYPRLL

SEQ ID NO: 12174 - protein, 423 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMRVFLSGMPELRLGLNDKVLFDNTGRGKSKSVELEDVKFHQCVRLSRFENDRTISFIPPDGEFELMSYRLNTHVKPLIWIESVIEKHSHSRIEYMIKAKSQFKRRSTANNVEIHIPVPNDADSPKFKTTVGSVKWVPENSEIVWSIKSFPGGKEYLMRAHFGLPSVEAEDKEGKPPISVKFEIPYFTTSGIQVRYLKIIEKSGYQALPWVRYITQNGDYQLRTQ

SEQ ID NO: 12175 - protein, 651 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDADTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 12176 - protein, 650 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 12177 - protein, 493 aa, Homo sapiens
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 12178 - protein, 352 aa, Homo sapiens [sequence omitted]

SEQ ID NO: 12179 - protein, 338 aa, Homo sapiens
MERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKVGVAPLPAIRPQLCL

SEQ ID NO: 12180 - protein, 341 aa, Homo sapiens
MERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 12181 - protein, 360 aa, Homo sapiens
MERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQGRKASTAPGAEASPSPCITERSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQSIIRKVVDPETGRTRLIKGDGEVLEEIVTKERHREINKQATRGDCLAFQMRAGLLP

SEQ ID NO: 12182 - protein, 536 aa, Homo sapiens
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 12183 - protein, 703 aa, Homo sapiens
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 12184 - protein, 3056 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 12185 - protein, 1708 aa, Homo sapiens
MTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 12186 - protein, 382 aa, Homo sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVVEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 12187 - protein, 247 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 12188 - protein, 255 aa, Homo sapiens
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 12189 - protein, 247 aa, Homo sapiens; identical to SEQ ID NO: 12187

SEQ ID NO: 12190 - protein, 247 aa, Homo sapiens; identical to SEQ ID NO: 12187

SEQ ID NO: 12191 - protein, 262 aa, Homo sapiens
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 12192 - protein, 247 aa, Homo sapiens; identical to SEQ ID NO: 12187

SEQ ID NO: 12193 - protein, 158 aa, Homo sapiens
MNQEKLAKLQAQVRIGGKGTARRKKKVVHRTATADDKKLQSSLKKLAVNNIAGIEEVNMIKDDGTVIHFNNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 12194 - protein, 171 aa, Homo sapiens
MHPFYTRAATMIGEIAAAVSFISKFLRTKGLTSERQLQTFSQSLQELLAEHYKHHWFPEKPCKGSGYRCIRINHKMDPLIGQAAQRIGLSSQELFRLLPSELTLWVDPYEVSYRIGEDGSICVLYEASPAGGSTQNSTNVQMVDSRISCKEELLLGRTSPSKNYNMMTVSG

SEQ ID NO: 12195 - protein, 353 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIHFMKAFQKIVVLFYKAEVLSEEPILKWYKDAHVAKGKSVFLEQMKKFVEWLKNAEEESESEAEEGD

SEQ ID NO: 12196 - protein, 110 aa, Homo sapiens
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQLLGFTPSSG

SEQ ID NO: 12197 - protein, 342 aa, Homo sapiens
MPFLLGLRQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQPSEEQAREPGHPHLPRPPACLLLNTINEQDSPNSQSSSSPS

SEQ ID NO: 12198 - protein, 265 aa, Homo sapiens
MPMRHRKKAADKNLPCRPLVCAVLDLMVEFIVTHMMKEFPMDLYIRCIQVVHKLLCYQKKCRVRLHYTWRELWSALINLLKFLMSNETVLLAKHNIFTLALMIVNLFNMFITYGDTFLPTPSSYDELYYEIIRMHQSFDNLYSMVLRLSTNAGQWKEAASKVTHALVNIRAIINHFNPKIESYAAVNHISQLSEEQVLEVVRANYDTLTLKLQDGLDQYERYSEQHKEAAFFKELVRSISTNVRRNLVFHTLSQEVLLKEFSTIS

SEQ ID NO: 12199 - protein, 498 aa, Homo sapiens
MDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEEDTIHHHGTSILTLFRSPTQVNNLIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 12200 - protein, 362 aa, Homo sapiens
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVPSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYSIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 12201 - protein, 228 aa, Homo sapiens
MTKEFESEVLKLQQHAMIENQAGQVEIDKLQHLLQMKDREMNRVKKLAKNILDERTEVERFFLDALHQVKQQILISRKHYKQIAQAAFNLKMRAACTGRTEYPKIRTFDGREHSTNSVNQDLLEAEKWTHIEGNVDIGDLTWEQKEKVLRLLFAKMNGCPSRKYNQSSRPPVPDYVVSDSGETKEFGDESKLQDKIFITQQIAISDSSGEVVLPTIPKEPQESDTGTF

SEQ ID NO: 12202 - protein, 991 aa, Homo sapiens
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 12203 - protein, 184 aa, Homo sapiens
MDLQAAGAQAQGAAEPSRGPPLPSARGAPPSPEAGFATADHSGQERETEKAMDRLARGTQSIPNDSPARGEGTHSEEEGFAMDEEDSDGELNTWELSEGTNCPPKEQPGDLFNEDWDSELKADQGNPYDADDIQESISQELKPWVCCAPQGDMIYDPSWHHPPPLIPYYSKMVFETGQFDDAED

SEQ ID NO: 12204 - protein, 470 aa, Homo sapiens
MEFAAENEGKSGGGLHSVAEGVRLSPEPGREGVRDLAGAEEFGGGEEGTGLTGIKEIGDGEEGSGQRPEEIPMDLTVVKQEIIDWPGTEGRLAGQWVEQEVEDRPEVKDENAGVLEVKQETDSSLVVKEAKVGEPEVKEEKVKGEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCNGVRDKTAYISIQQFTEMNLLSDYRFLEDVARTADHISRDAFLKRPISNKYMYFMKNRARRQGINLKLLPNGFTKRKENSTFFDKKKQQFCWHVKLQFPQSQAEYIEKRVPDDKTINEILKPYIDPEKSDPVIRQRLKAYIRSQTGVQILMKIEYMQQNLVRYYELDPYKSLLDNLRNKVIIEYPTLHVVLKGSNNDMKVLHQVKSESTKNVGNEN

SEQ ID NO: 12205 - protein, 380 aa, Homo sapiens
MARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 12206 - protein, 91 aa, Homo sapiens
MAASSRAQVLSLYRAMLRESKRFSAYNYRTYAVRRIRDAFRENKNVKDPVEIQTLVNKAKRDLGVIRRQVHIGQLYSTDKLIIENRDMPRT

SEQ ID NO: 12207 - protein, 327 aa, Homo sapiens
MAAAAAMAEQESARNGGRNRGGVQRVEGKLRASVEKGDYYEAHQMYRTLFFRYMSQSKHTEARELMYSGALLFFSHGQQNSAADLSMLVLESLEKAEVEVADELLENLAKVFSLMDPNSPERVTFVSRALKWSSGGSGKLGHPRLHQLLALTLWKEQNYCESRYHFLHSADGEGCANMLVEYSTSRGFRSEVDMFVAQAVLQFLCLKNKSSASVVFTTYTQKHPSIEDGPPFVEPLLNFIWFLLLAVDGGKLTVFTVLCEQYQPSLRRDPMYNEYLDRIGQLFFGVPPKQTSSYGGLLGNLLTSLMGSSEQEDGEESPSDGSPIELD

SEQ ID NO: 12208 - protein, 271 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEINIQQLTNYRKSVMSLAEAGKLYRKDLEIVLCSEPPM

SEQ ID NO: 12209 - protein, 179 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRA

SEQ ID NO: 12210 - protein, 192 aa, Homo sapiens
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRIEAATLTSMSWMPF

SEQ ID NO: 12211 - protein, 526 aa, Homo sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 12212 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACARCNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPHHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPRTCDDTVTYSALHKRQVGDYENVIPDFPEDEGIHYSELIQFGVGERPQAQENVDYVILKH

SEQ ID NO: 12213 - protein, 459 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTLSISRTKTVLR

SEQ ID NO: 12214 - protein, 498 aa, Homo sapiens
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 12215 - protein, 790 aa, Homo sapiens
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSSAGLSTGALIAILLCVLILLAIVVLFITLRRSKKEPLIISEEDVRENVVTYDDEGGGEEDTEAFDITALRNPSAAEELKYRRDIRPEVKLTPRHQTSSTLESIDVQEFIKQRLAEADLDPSVPPYDSLQTYAYEGQRSEAGSISSLDSATTQSDQDYHYLGDWGPEFKKLAELYGEIESERTT

SEQ ID NO: 12216 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 12217 - protein, 1460 aa, Homo sapiens
MAGRPLRIGDQLVLEEDYDETYIPSEQEILEFAREIGIDPIKEPELMWLAREGIVAPLPGEWKPCQDITGDIYYFNFANGQSMWDHPCDEHYRSLVIQERAKLSTSGAIKKKKKKKEKKDKKDRDPPKSSLALGSSLAPVHVPLGGLAPLRGLVDTPPSALRGSQSVSLGSSVESGRQLGELMLPSQGLKTSAYTKGLLGSIYEDKTALSLLGLGEETNEEDEEESDNQSVHSSSEPLRNLHLDIGALGGDFEYEESLRTSQPEEKKDVSLDSDAAGPPTPCKPSSPGADSSLSSAVGKGRQGSGARPGLPEKEENEKSEPKICRNLVTPKADPTGSEPAKASEKEAPEDTVDAGEEGSRREEAAKEPKKKASALEEGSSDASQELEISEHMKEPQLSDSIASDPKSFHGLDFGFRSRISEHLLDVDVLSPVLGGACRQAQQPLGIEDKDDSQSSQDELQSKQSKGLEERLSPPLPHEERAQSPPRSLATEEEPPQGPEGQPEWKEAEELGEDSAASLSLQLSLQREQAPSPPAACEKGKEQHSQAEELGPGQEEAEDPEEKVAVSPTPPVSPEVRSTEPVAPPEQLSEAALKAMEEAVAQVLEQDQRHLLESKQEKMQQLREKLCQEEEEEILRLHQQKEQSLSSLRERLQKAIEEEEARMREEESQRLSWLRAQVQSSTQADEDQIRAEQEASLQKLREELESQQKAERASLEQKNRQMLEQLKEEIEASEKSEQAALNAAKEKALQQLREQLEGERKEAVATLEKEHSAELERLCSSLEAKHREVVSSLQKKIQEAQQKEEAQLQKCLGQVEHRVHQKSYHVAGYEHELSSLLREKRQEVEGEHERRLDKMKEEHQQVMAKAREQYEAEERKQRAELLGHLTGELERLQRAHERELETVRQEQHKRLEDLRRRHREQERKLQDLELDLETRAKDVKARLALLEVQEETARREKQQLLDVQRQVALKSEEATATHQQLEEAQKEHTHLLQSNQQLREILDELQARKLKLESQVDLLQAQSQQLQKHFSSLEAEAQKKQHLLREVTVEENNASPHFEPDLHIEDLRKSLGTNQTKEVSSSLSQSKEDLYLDSLSSHNVWHLLSAEGVALRSAKEFLVRQTRSMRRRQTALKAAQQHWRHELASAQEVAKDPPGIKALEDMRKNLEKETRHLDEMKSAMRKGHNLLKKKEEKLNQLESSLWEEASDEGTLGGSPTKKAVTFDLSDMDSLSSESSESFSPPHREWWRQQRIDSTPSLTSRKIHGLSHSLRQISSQLSSVLSILDSLNPQSPPPLLASMPAQLPPRDPKSTPTPTYYGSLARFSALSSATPTSTQWAWDSGQGPRLPSSVAQTVDDFLLEKWRKYFPSGIPLLSNSPTPLESRLGYMSASEQLRLLQHSHSQVPEAGSTTFQGIIEANRRWLERVKNDPRLPLFSSTPKPKATLSLLQLGLDEHNRVKVYRF

SEQ ID NO: 12218 - protein, 532 aa, Homo sapiens
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 12219 - protein, 502 aa, Homo sapiens
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 12220 - protein, 381 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 12221 - protein, 271 aa, Homo sapiens
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 12222 - protein, 221 aa, Homo sapiens
MGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 12223 - protein, 1224 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKVSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 12224 - protein, 276 aa, Homo sapiens
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQCFCFEEQRLNPQEEVDMPVFFYIDPEFAEDPRMIKVDLITLSYTFFEAKEGHKLPVPGYN

SEQ ID NO: 12225 - protein, 442 aa, Homo sapiens [sequence omitted]

SEQ ID NO: 12226 - protein, 651 aa, Homo sapiens
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 12227 - protein, 563 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 12228 - protein, 476 aa, Homo sapiens
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYGELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 12229 - protein, 460 aa, Homo sapiens
MASLLQSDRVLYLVQGEKKVRAPLSQLYFCRYCSELRSLECVSHEVDSHYCPSCLENMPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIMSIPNLRYMKESQVLLTLTNPVENLTHVTLFECEEGDPDDINSTAKVVVPPKELVLAGKDAAAEYDELAEPQDFQDDPDIIAFRKANKVGIFIKVTPQREEGEVTVCFKMKHDFKNLAAPIRPIEESDQGTEVIWLTQHVELSLGPLLP

SEQ ID NO: 12230 - protein, 881 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEMGFAEQLQEIIARLPGGHQTVLFSATLPKLLVEFARAGLTEPVLIRLDVDTKLNEQLKTSFFLVREDTKAAVLLHLLHNVVRPQDQTVVFVATKHHAEYLTELLTTQRVSCAHIYSALDPTARKINLAKFTLGKCSTLIVTDLAARGLDIPLLDNVINYSFPAKGKLFLHRVGRVARAGRSGTAYSLVAPDEIPYLLDLHLFLGRSLTLARPLKEPSGVAGVDGMLGRVPQSVVDEEDSGLQSTLEASLELRGLARVADNAQQQYVRSRPAPSPESIKRAKEMDLVGLGLHPLFSSRFEEEELQRLRLVDSIKNYRSRATIFEINASSRDLCSQVMRAKRQKDRKAIARFQQGQQGRQEQQEGPVGPAPSRPALQEKQPEKEEEEEAGESVEDIFSEVVGRKRQRSGPNRGAKRRREEARQRDQEFYIPYRPKDFDSERGLSISGEGGAFEQQAAGAVLDLMGDEAQNLTRGRQQLKWDRKKKRFVGQSGQEDKKKIKTESGRYISSSYKRDLYQKWKQKQKIDDRDSDEEGASDRRGPERRGGKRDRGQGASRPHAPGTPAGRVRPELKTKQQILKQRRRAQKLHFLQRGGLKQLSARNRRRVQELQQGAFGRGARSKKGKMRKRM

SEQ ID NO: 12231 - protein, 1065 aa, Homo sapiens
MDAAGRGCHLLPLPAARGPARAPAAAAAAAASPPGPCSGAACAPSAAAGAGAMNPSSSAGEEKGATGGSSSSGSGAGSCCLGAEGGADPRGAGSAAAAGAAALDEPAAAGQKEKDEALEEKLRNLTFRKQVSYRKAISRAGLQHLAPAHPLSLPVANGPAKEPRATLDWSENAVNGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGMEQENKGRPFVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTVVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGFHYDKEKLREASISDWLRTIAGELVQSFGAIPLGILVVRGDCDLETCRMYIDRLQEDLQSVSSGSQRVHYQDHETSFPRALSAQRLSPRWCFLDDRSQEHLHFVMEISQDEIFILDPDMVVSQPAGTPPGMPDLVVEQASGISDWWNPALRKRMLSDSGLGMIAPYYEDSDLKDLSHSRVLQSPVSSEDHAILQAVIAGDLMKLIESYKNGGSLLIQGPDHCSLLHYAAKTGNGEIVKYILDHGPSELLDMADSETGETALHKAACQRNRAVCQLLVDAGASLRKTDSKGKTPQERAQQAGDPDLAAYLESRQNYKVIGHEDLETAV

SEQ ID NO: 12232 - protein, 1369 aa, Homo sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 12233 - protein, 1571 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 12234 - protein, 889 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQVGAPARPMVR

SEQ ID NO: 12235 - protein, 841 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 12236 - protein, 812 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPVSMSSCTSTGSQRR

SEQ ID NO: 12237 - protein, 441 aa, Homo sapiens
MDDDDFGGFEAAETFDGGSGETQTTSPAIPWAAFPAVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAVKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 12238 - protein, 570 aa, Homo sapiens
MSYQGKKNIPRITSDRLLIKGGRIVNDDQSFYADIYMEDGLIKQIGDNLIVPGGVKTIEANGKMVIPGGIDVHTHFQMPYKGMTTVDDFFQGTKAALAGGTTMIIDHVVPEPESSLTEAYEKWREWADGKSCCDYALHVDITHWNDSVKQEVQNLIKDKGVNSFMVYMAYKDLYQVSNTELYEIFTCLGELGAIAQVHAENGDIIAQEQTRMLEMGITGPEGHVLSRPEELEAEAVFRAITIASQTNCPLYVTKVMSKSAADLISQARKKGNVVFGEPITASLGIDGTHYWSKNWAKAAAFVTSPPLSPDPTTPDYINSLLASGDLQLSGSAHCTFSTAQKAIGKDNFTAIPEGTNGVEERMSVIWDKAVATGKMDENQFVAVTSTNAAKIFNLYPRKGRISVGSDSDLVIWDPDAVKIVSAKNHQSAAEYNIFEGMELRGAPLVVICQGKIMLEDGNLHVTQGAGRFIPCSPFSDYVYKRIKARRKMADLHAVPRGMYDGPVFDLTTTPKGGTPAGSARGSPTRPNPPVRNLHQSGFSLSGTQVDEGVRSASKRIVAPPGGRSNITSLS

SEQ ID NO: 12239 - protein, 340 aa, Homo sapiens
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 12240 - protein, 1267 aa, Homo sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 12241 - protein, 479 aa, Homo sapiens
MSSPGIDGDPKPPCLPRNGLVKLPGQPNGLGAASITKGTPATKNRPCQPPPPPTLPPPSLAAPLSRAALAGGPCTPAGGPASALAPGHPAERPPLATDEKILNGLFWYFSACEKCVLAQVCKAWRRVLYQPKFWAGLTPVLHAKELYNVLPGGEKEFVNLQGFAARGFEGFCLVGVSDLDICEFIDNYALSKKGVKAMSLKRSTITDAGLEVMLEQMQGVVRLELSGCNDFTEAGLWSSLSARITSLSVSDCINVADDAIAAISQLLPNLAELSLQAYHVTDTALAYFTARQGHSTHTLRLLSCWEITNHGVVNVVHSLPNLTALSLSGCSKVTDDGVELVAENLRKLRSLDLSWCPRITDMALEYVACDLHRLEELVLDRCVRITDTGLSYLSTMSSLRSLYLRWCCQVQDFGLKHLLALGSLRLLSPAGCPLLTTTGLSGLVQLQELEELELTNCPGATPELFKYFSQHLPRCLVIE

SEQ ID NO: 12242 - protein, 276 aa, Homo sapiens
MNVSESHFVSALTVVFINSKSLSSIKIEDTPVDDPSLKILVANNSDTLRLPKMSSCPHVSSDGILCVADRCQGLRELALNYYILTDELFLALSSETHVNLEHLRIDVVSENPGQIKFHAVKKHSWDALIKHSPRVNVVMHFFLYEEEFETFFKEETPVTHLYFGRSVSKVVLGRVGLNCPRLIELVVCANDLQPLDNELICIAEHCTNLTALGLSKCEVSCSAFIRFVRLCERRLTQLSVMEEVLIPDEDYSLDEIHTEVSKYLGRVWFPDVMPLW

SEQ ID NO: 12243 - protein, 392 aa, Homo sapiens
MEAPLVSLDEEFEDLRPSCSEDPEEKPQCFYGSSPHHLEDPSLSELENFSSEIISFKSMEDLVNEFDEKLNVCFRNYNAKTENLAPVKNQLQIQEEEETLQDEEVWDALTDNYIPSLSEDWRDPNIEALNGNCSDTEIHEKEEEEFNEKSENDSGINEEPLLTADQVIEEIEEMMQNSPDPEEEEEVLEEEDGGETSSQADSVLLQEMQALTQTFNNNWSYEGLRHMSGSELTELLDQVEGAIRDFSEELVQQLARRDELEFEKEVKNSFITVLIEVQNKQKEQRELMKKRRKEKGLSLQSSRIEKGNQMPLKRFSMEGISNILQSGIRQTFGSSGTDKQYLNTVIPYEKKASPPSVEDLQMLTNILFAMKEDNEKVPTLLTDYILKVLCPT

SEQ ID NO: 12244 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 12245 - protein, 108 aa, Homo sapiens; identical to SEQ ID NO: 12244

SEQ ID NO: 12246 - protein, 276 aa, Homo sapiens
MLRDSEAEVTEEDPRLRAQQLHHRVLTLQCQLRDQGAAHQASLDEATRLQEELQAKLEELQKKQHEAKLAVTPLKAKIASLVRKCRERNRLITHLLQELHRHGLGNLLLSELAQNMLNDVALAEYTATFLAPGVPETSHHLDVKSEMTAALRAQTYLLNPEMDSVLQSSLSSESWPIPEPEWPAQTAQLDSLKLPLSLVSTLDPGTCLAAVTVEPGLPAQRLQEKGGMPCPALQVDNVPAPSELLSPARILAFHQELRQSICSNSQVHKSPLELEM

SEQ ID NO: 12247 - protein, 1204 aa, Homo sapiens
MYVTMMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSSYITREDQYSKPPHKKLKDRQIDRQNRLNRPPSAIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYTFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 12248 - protein, 108 aa, Homo sapiens
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHSRNSQG

SEQ ID NO: 12249 - protein, 184 aa, Homo sapiens
MAEPQPPSGGLTDEAALSCCSDADPSTKDFLLQQTMLRVKDPKKSLDFYTRVLGMTLIQKCDFPIMKFSLYFLAYEDKNDIPKEKDEKIAWALSRKATLELTHNWGTEDDATQSYHNGNSDPRGFGHIGIAVPDVYSACKRFEELGVKFVKKPDDGKMKGLAFIQDPDGYWIEILNPNKMATLM

SEQ ID NO: 12250 - protein, 838 aa, Homo sapiens
MTGAEIEPSAQAKPEKKAGEEVIAGPERENDVPLVVRPKVRTQATTGARPKTETKSVPAARPKTEAQAMSGARPKTEVQVMGGARPKTEAQGITGARPKTDARAVGGARSKTDAKAIPGARPKDEAQAWAQSEFGTEAVSQAEGVSQTNAVAWPLATAESGSVTKSKGLSMDRELVNVDAETFPGTQGQKGIQPWFGPGEETNMGSWCYSRPRAREEASNESGFWSADETSTASSFWTGEETSVRSWPREESNTRSRHRAKHQTNPRSRPRSKQEAYVDSWSGSEDEASNPFSFWVGENTNNLFRPRVREEANIRSKLRTNREDCFESESEDEFYKQSWVLPGEEANSRFRHRDKEDPNTALKLRAQKDVDSDRVKQEPRFEEEVIIGSWFWAEKEASLEGGASAICESEPGTEEGAIGGSAYWAEEKSSLGAVAREEAKPESEEEAIFGSWFWDRDEACFDLNPCPVYKVSDRFRDAAEELNASSRPQTWDEVTVEFKPGLFHGVGFRSTSPFGIPEEASEMLEAKPKNLELSPEGEEQESLLQPDQPSPEFTFQYDPSYRSVREIREHLRARESAESESWSCSCIQCELKIGSEEFEEFLLLMDKIRDPFIHEISKIAMGMRSASQFTRDFIRDSGVVSLIETLLNYPSSRVRTSFLENMIHMAPPYPNLNMIETFICQVCEETLAHSVDSLEQLTGIRMLRHLTMTIDYHTLIANYMSGFLSLLTTANARTKFHVLKMLLNLSENPAVAKKLFSAKALSIFVGLFNIEETNDNIQIVIKMFQNISNIIKSGKMSLIDDDFSLEPLISAFREFEELAKQLQAQIDNQNDPEVGQQS

SEQ ID NO: 12251 - protein, 838 aa, Homo sapiens; identical to SEQ ID NO: 12250

SEQ ID NO: 12252 - protein, 403 aa, Homo sapiens
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 12253 - protein, 517 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDDEAFEDSDDGDFEGQEVDYMSDGSSSSQEEPESKAKAPQQEEGPKGVDEQSDSSEESEEEKPPEEDKEEEEEKKAPTPQEKKRRKDSSEESDSSEESDIDSEASSAFFMAKKKTPPKRERKPSGGSSRGNSRPGTPSAEGGSTSSTLRAAASKLEQGKRVSEMPAAKRLRLDTGPQSLSGKSTPQPPSGKTTPNSGDVQVTEDAVRRYLTRKPMTTKDLLKKFQTKKTGLSSEQTVNVLAQILKRLNPERKMINDKMHFSLKE

SEQ ID NO: 12254 - protein, 136 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 12255 - protein, 351 aa, Homo sapiens
MSLVCLTDFQAHAREQLSKSTRDFIEGGADDSITRDDNIAAFKRIRLRPRYLRDVSEVDTRTTIQGEEISAPICIAPTGFHCLVWPDGEMSTARAAQAAGICYITSTFASCSLEDIVIAAPEGLRWFQLYVHPDLQLNKQLIQRVESLGFKALVITLDTPVCGNRRHDIRNQLRRNLTLTDLQSPKKGNAIPYFQMTPISTSLCWNDLSWFQSITRLPIILKGILTKEDAELAVKHNVQGIIVSNHGGRQLDEVLASIDALTEVVAAVKGKIEVYLDGGVRTGNDVLKALALGAKCIFLGRPILWGLACKGEHGVKEVLNILTNEFHTSMALTGCRSVAEINRNLVQFSRL

SEQ ID NO: 12256 - protein, 351 aa, Homo sapiens; identical to SEQ ID NO: 12255

SEQ ID NO: 12257 - protein, 131 aa, Homo sapiens
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRAGAEPAPRPCLGRRCSAPAAASVAPGGQSGI

SEQ ID NO: 12258 - protein, 1215 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 12259 - protein, 662 aa, Homo sapiens
MMEPEEYRERGREMVDYICQYLSTVRERRVTPDVQPGYLRAQLPESAPEDPDSWDSIFGDIERIIMPGVVHWQSPHMHAYYPALTSWPSLLGDMLADAINCLGFTWASSPACTELEMNVMDWLAKMLGLPEHFLHHHPSSQGGGVLQQTVSESTLIALLAARKNKILEMKTSEPDADESCLNARLVAYASDQAHSSVEKAGLISLVKMKFLPVDDNFSLRGEALQKAIEEDKQRGLVPVFVCATLGTTGVCAFDCLSELGPICAREGLWLHIDAAYAGTAFLCPEFRGFLKGIEYADSFTFNPSKWMMVHFDCTGFWVKDKYKLQQTFSVNPIYLRHANSGVATDFMHWQIPLSRRFRSVKLWFVIRSFGVKNLQAHVRHGTEMAKYFESLVRNDPSFEIPAKRHLGLVVFRLKGPNCLTENVLKEIAKAGRLFLIPATIQDKLIIRFTVTSQFTTRDDILRDWNLIRDAATLILSQHCTSQPSPRVGNLISQIRGARAWACGTSLQSVSGAGDDPVQARKIIKQPQRVGAGPMKRENGLHLETLLDPVDDCFSEEAPDATKHKLSSFLFSYLSVQTKKKTVRSLSCNSVPVSAQKPLPTEASVKNGGSSRVRIFSRFPEDMMMLKKSAFKKLIKFYSVPSFPECSSQCGLQLPCCPLQAMV

SEQ ID NO: 12260 - protein, 1942 aa, Homo sapiens
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSVPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 12261 - protein, 214 aa, Homo sapiens
MAGENFATPFHGHVGRGAFSDVYEPAEDTFLLLNALEAAAAELAGVEICLEVGSGSGVVSAFLASMIGPQALYMCTDINPEAAACTLETARCNKVHIQPVITDLVKGLLPRLTEKVDLLVFNPPYVVTPPQEVGSHGIEAAWAGGKNGREVMDRFFPLVPDLLSPKGLFYLVTIKENNPEEILKIMKTKGLQGTTALSRQAGQETLSVLKFTKS

SEQ ID NO: 12262 - protein, 186 aa, Homo sapiens
MAGENFATPFHGHVGRGAFSDVYEPAEDTFLLLNALEAAAAELAGVEICLEVGSGSGVVSAFLASMIGPQALYMCTDINPEAAACTLETARCNKVHIQPVITDLVGSHGIEAAWAGGKNGREVMDRFFPLVPDLLSPKGLFYLVTIKENNPEEILKIMKTKGLQGTTALSRQAGQETLSVLKFTKS

SEQ ID NO: 12263 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 12264 - protein, 170 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGSRSGSSSSSGTLWDPPGPM

SEQ ID NO: 12265 - protein, 923 aa, Homo sapiens
MNHSQLKPCIINIVILRLLRRAQLDPIYGRRDSASGASTSLGPELPWSPAGGLEAVPRARPPRRSLVCGLGPARAGVHPARLCAGPGPLPWDPGGQTEAGGDWRGRPRESAGRAGLAEGLQAWPFGDFQRGDAPRGPEGLKSAPAAQPRARHYPRRGRLRGDRSVPKPGEERPGLGGPLWAGGERSSGARQFPAPAFPDLSRPARARRALPLPGGSDTARAPPRTRTETRTGTGAALEAPLAVRGCATMADKEAGGSDGPRETAPTSAYSSPARSLGDTGITPLSPSHIVNDTDSNVSEQQSFLVVVAVDFGTTSSGYAYSFTKEPECIHVMRRWEGGDPGVSNQKTPTTILLTPERKFHSFGYAARDFYHDLDPNEAKQWLYLEKFKMKLHTTGDLTMDTDLTAANGKKVKALEIFAYALQYFKEQALKELSDQAGSEFENSDVRWVITVPAIWKQPAKQFMRQAAYQAGLASPENSEQLIIALEPEAASIYCRKLRLHQMIELSSKAAVNGYSGSDTVGAGFTQAKEHIRRNRQSRTFLVENVIGEIWSELEEGDKYVVVDSGGGTVDLTVHQIRLPEGHLKELYKATGGPYGSLGVDYEFEKLLYKIFGEDFIEQFKIKRPAAWVDLMIAFESRKRAAAPDRTNPLNITLPFSFIDYYKKFRGHSVEHALRKSNVDFVKWSSQGMLRMSPDAMNALFKPTIDSIIEHLRDLFQKPEVSTVKFLFLVGGFAEAPLLQQAVQAAFGDQCRIIIPQDVGLTILKGAVLFGLDPAVIKVRRSPLTYGVGVLNRYVEGKHPPEKLLVKDGTRWCTDVFDKFISADQSVALGELVKRSYTPAKPSQLVIVINIYSSEHDNVSFITDPGVKKCGTLRLDLTGTSGTAVPARREIQTLMQFGDTEIKATAIDIATSKSVKVGIDFLNY

SEQ ID NO: 12266 - protein, 592 aa, Homo sapiens
MRRWEGGDPGVSNQKTPTTILLTPERKFHSFGYAARDFYHDLDPNEAKQWLYLEKFKMKLHTTGDLTMDTDLTAANGKKVKALEIFAYALQYFKEQALKELSDQAGSEFENSDVRWVITVPAIWKQPAKQFMRQAAYQAGLASPENSEQLIIALEPEAASIYCRKLRLHQMIELSSKAAVNGYSGSDTVGAGFTQAKEHIRRNRQSRTFLVENVIGEIWSELEEGDKYVVVDSGGGTVDLTVHQIRLPEGHLKELYKATGGPYGSLGVDYEFEKLLYKIFGEDFIEQFKIKRPAAWVDLMIAFESRKRAAAPDRTNPLNITLPFSFIDYYKKFRGHSVEHALRKSNVDFVKWSSQGMLRMSPDAMNALFKPTIDSIIEHLRDLFQKPEVSTVKFLFLVGGFAEAPLLQQAVQAAFGDQCRIIIPQDVGLTILKGAVLFGLDPAVIKVRRSPLTYGVGVLNRYVEGKHPPEKLLVKDGTRWCTDVFDKFISADQSVALGELVKRSYTPAKPSQLVIVINIYSSEHDNVSFITDPGVKKCGTLRLDLTGTSGTAVPARREIQTLMQFGDTEIKATAIDIATSKSVKVGIDFLNY

SEQ ID NO: 12267 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGDTKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 12268 - protein, 918 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 12269 - protein, 329 aa, Homo sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDNIASF

SEQ ID NO: 12270 - protein, 748 aa, Homo sapiens
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGTYQGQWVGGMRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 12271 - protein, 257 aa, Homo sapiens
MSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIKQEPLD

SEQ ID NO: 12272 - protein, 153 aa, Homo sapiens
MGGFGSRFWQEGVWDRDLEKSTRLEEDAMESEPLAGTKTRGRGRRRWEARHGWTLPAHASQPSPRTVVATATGAEVSACAGRSAGTRVARPESQLSHLYGWDKYSNPRPSRRARAVARVHALEQAPILCRALRWGLTQFLRGTSPVTQSVPFS

SEQ ID NO: 12273 - protein, 97 aa, Homo sapiens [sequence omitted]

SEQ ID NO: 12274 - protein, 1278 aa, Homo sapiens
MQKFLEKGGNFWVTAMETGVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSCPTRWYWKLVPHAIAFCLKESGSKPPMIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 12275 - protein, 1278 aa, Homo sapiens; identical to SEQ ID NO: 12274

SEQ ID NO: 12276 - protein, 1138 aa, Homo sapiens
MAPTLFQKLFSKRTGLGAPGRDARDPDCGFSWPLPEFDPSQIRLIVYQDCERRGRNVLFDSSVKRRNEDISVSKLCSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECRMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 12277 - protein, 1166 aa, Homo sapiens
MAPTLFQKLFSKRTGLGAPGRDARDPDCGFSWPLPEFDPSQIRLIVYQDCERRGRNVLFDSSVKRRNEDISVSKLCSDAQVKVFGKCCQLKPGGDSSSSLDSSVTSSSDIKDQCLKYQGSRCSSDANMLGEMMFGSVAMSYKGSTLKIHQIRSPPQLMLSKVFTARTGSSICGSLNTLQDSLEFINQDNNTLKADNNTVINGLLGNIGLSQFCSPRRAFSEQGPLRLIRSASFFAVHSNPMDMPGRELNEDRDSGIARSASLSSLLITPFPSPNSSLTRSCASSYQRRWRRSQTTSLENGVFPRWSIEESFNLSDESCGPNPGIVRKKKIAIGVIFSLSKDEDENNKFNEFFFSHFPLFESHMNKLKSAIEQAMKMSRRSADASQRSLAYNRIVDALNEFRTTICNLYTMPRIGEPVWLTMMSGTPEKNHLCYRFMKEFTFLMENASKNQFLPALITAVLTNHLAWVPTVMPNGQPPIKIFLEKHSSQSVDMLAKTHPYNPLWAQLGDLYGAIGSPVRLARTVVVGKRQDMVQRLLYFLTYFIRCSELQETHLLENGEDEAIVMPGTVITTTLEKGEIEESEYVLVTMHRNKSSLLFKESEEIRTPNCNCKYCSHPLLGQNVENISQQEREDIQNSSKELLGISDECRMISPSDCQEENAVDVKQYRDKLRTCFDAKLETVVCTGSVPVDKCALSESGLESTEETWQSEKLLDSDSHTGKAMRSTGMVVEKKPPDKIVPASFSCEAAQTKVTFLIGDSMSPDSDTELRSQAVVDQITRHHTKPLKEERGAIDQHQETKQTTKDQSGESDTQNMVSEEPCELPCWNHSDPESMSLFDEYFNDDSIETRTIDDVPFKTSTDSKDHCCMLEFSKILCTKNNKQNNEFCKCIETVPQDSCKTCFPQQDQRDTLSILVPHGDKESSDKKIAVGTEWDIPRNESSDSALGDSESEDTGHDMTRQVSSYYGGEQEDWAEEDEIPFPGSKLIEVSAVQPNIANFGRSLLGGYCSSYVPDFVLQGIGSDERFRQCLMSDLSHAVQHPVLDEPIAEAVCIIADMDKWTVQVASSQRRVTDNKLGKEVLVSSLVSNLLHSTLQLYKHNLSPNFCVMHLEDRLQELYFKSKMLSEYLRGQMRVHVKELGVVLGIESSDLPLLAAVASTHSPYVAQILL

SEQ ID NO: 12278 - protein, 814 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMKEEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDFQHERSQLLSNKSSGGWEVQDQGTGRFDVCDVNARKILPSPCPSPHSQKQSSTSTPLGDSIPKRPVSSIPLTGDSQTDSDIIAFIKARQSILQKQCLGSN

SEQ ID NO: 12279 - protein, 188 aa, Homo sapiens [sequence omitted]

SEQ ID NO: 12280 - protein, 189 aa, Homo sapiens [sequence omitted]

SEQ ID NO: 12281 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 12282 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 12283 - protein, 161 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 12284 - protein, 145 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 12285 - protein, 145 aa, Homo sapiens; identical to SEQ ID NO: 12284

SEQ ID NO: 12286 - protein, 1158 aa, Homo sapiens
MHAFCVGQYLEPDQEGVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPHWRRIAQKIIREPRKKRVPKKPESTDDEEKIGNEESDLEEACILPHSPINVDKRPIAIKSPKDKWQPLLSTVTGVHKYKWLKQNVQGLYPQSPLLSTIAEFALKEEPVDVEKRKCLLKQLERAEVRLEGIDTILKLYLVSKNFLLPSVPYAMFCGWQRLIPEGIDIGEPLTDCLKDVDLIPPFNRMLLEVTFGKLYAWAVQNIRNVLVDASAKFKELGIQPVPLQTITNENPSGPSLGTIPQAHFLLVMLSMLTLQHSANNLDLLLNSGTLALAQTALRLIGPSCDSVEEDMNASAQGASATVLEETRKETAPVQLPVSGPELAAMMKIGTRVMRGVDWKWGDQDRPPPGLGRVIGELGEDGWIRVQWDTGSTNSYRMGKEGNYDLKLAELPAPAQPSAEDSDTEDDSEAEQTERNIHPTAMMFTSTINLLQTLCLSAGVHAEIMQSEATKTLCGLLQMLVYREQHRSWCTLGFVQSIALTLQVCGTLSSLQWITLLMKVVEGHAPFTATSLQRQILAVHLLQAVLPSWDKTERARDMKCLMEKLFDFLGSLLTMCSSDVPLLRESTLRRRRVCPQASLTATHSSTLAEEVVALLHTLHSLTQWNGLINKYINSQLRSITHSFAGRPSKGAQLEDYFPDSENPEVGGLMAVLAVVGGIDGRLCLGGQVVHDDFGEVTMTRITLKGKITVQFSDMRTCHVCPLNQLKPLPAVAFNVNNLPFTEPMLSVWAQLVNLAGSKLEKHKIKKSTKQAFAGQVDLDLLRCQQLKLYILKAGRALFSHQDKLRQILSQPAVQETGTVHTDDGAVVSPDLGDMSPEGPQPPMILLQQLLASATQPSPVKAIFDKQELEERMSRCCFWRRRTTKLEQILLFIRRMNSVCEKENTNATASN

SEQ ID NO: 12287 - protein, 228 aa, Homo sapiens
MVRLTLDLIARNSNLKPRKEETISQCLKKITHINFSDKNIDAIEDLSLCKNLSVLYLYDNCISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLGTYLY

SEQ ID NO: 12288 - protein, 409 aa, Homo sapiens
MGNKQPQKVTVPTGTALQGVVLIVSTLHQPGGWICGKDPCCSLRPLSNSVQNALACKSKQDYQAGILFKTRAFISRDCGSDAAEDSASKGETYTLTLEHKAFGGKKNVERGVDIRQGPRGPRLGISTLGSRALRLARLQRELRAASRPAQNRRWNNQRLKCVHLGPGGGGGGPAAPRPTRAVWAAAGYISREPGRRGADGDSSGGERLGARRNSAPRAPCPPTGPPARPPSRGAPARAREGRRHPAADLDPPPGEPPAAASRGAPAQRPPSESPGAPPPGPADAGGAMAAKPGELMGICSSYQAVMPHFVCLADEFPQPVRPAKLPKGRGRLRRPRQSRFKTQPVTFDEIQEVEEEGVSPMEEEKAKKSFLQSLECLRRSTQSLSLQREQLSSCKLRNSLDSSDSDSAL

SEQ ID NO: 12289 - protein, 383 aa, Homo sapiens
MGNKQPQKVTVPTGTALQGVVLIVSALHQPGGWICGKDPCCSLRPLPNSVQNALACKSKQDYQAGILFKTRAFISRDCGSDAAEDSASKGETYTLTLEHKGAGEGDLRPAANPVGADLGIPEGTVPAQSRRLRVPVRAQARASRVLRGRGFSRNPRGAVWAAAGYISREPGRRGADGDSSAASPRSAAEQRPPSPVPPTSPPARPPSRGAPARAREAAATPQQIWIPRPASPRLLPPGGPRRSGRPRRAPAPRARPRRRRSAMAAKPGELMGICSSYQAVMPHFVCLADEFPQPVRPPSCPRAGPAAAPRQSRFKTQPVTFDEIQEVEEEGVSPMEEEKAKKSFLQSLECLRRSTQSLSLQREQLSSCKLRNSLDSSDSDSAL

SEQ ID NO: 12290 - protein, 163 aa, Homo sapiens
MDDKEPKRWPTLRDRLCSDGFLFPQYPIKPYHLKGIHRAVFYRDLEELKFVLLTRYDINKRDRKERTALHLACATGQPEMVHLLVSRRCELNLCDREDRTPLIKAVQLRQEACATLLLQNGADPNITDVFGRTALHYAVYNEDTSMIEKLLSYGANIEECSEV

SEQ ID NO: 12291 - protein, 369 aa, Homo sapiens [sequence omitted]

SEQ ID NO: 12292 - protein, 367 aa, Homo sapiens
MGSAQVGMGVAGRAGAHGLLTDPVPPSAAAPAPVTLLRVHPTANCSTSLVPRLRLASLPAALPSNRVVRVTTPPAGVRGAWRHSHFSRSRSIMDTSSEMLVRFGRRCGRAKESTEIRNSEEDQVLYLPLLPSKVDLQQVTIIPHDEWKRIQDSLDRLTREAACLRAERKAKKEMHLRSQEVVKHWTNTYAGMKEQKLEAKKKRDEEIEAERQILDLEEEIYKQGKRKKAIENAKQYQFYQTERVKNFHSGLLLSRVMKERDAQIEFRKSKIKSDKKWEEQLKLNIEKAFKEEQEKAEKRHRERVALAKDHLKQIKEHEEEEERRKKYEEKDAEEIKRQNALYEIEMRKKLEKKREEMHESRRRFLVS

SEQ ID NO: 12293 - protein, 108 aa, Homo sapiens [sequence omitted]

SEQ ID NO: 12294 - protein, 108 aa, Homo sapiens [sequence omitted]

SEQ ID NO: 12295 - protein, 224 aa, Homo sapiens
MSSQKQSAWKVIFKKKVSLLNIATRIMGGQKSGTEYPENLPTMKATVENKDSVLNTATKMKDVQTSTPEEQDLEMASEGEQKRLEEYENNQPQQLDDARNKADNQEKAILNIQARCDARVQNLQAECRKRRLLLEDSKRLVNELNHLKEKERQYEKKQAERELQETQDQLTATIRCTKGMEGDAQKLEVENAMMRKTIKKQDDQIERLEKILQRSSLMPQVFKS

SEQ ID NO: 12296 - protein, 176 aa, Homo sapiens
MSSQKQSAWKVIFKKKVSLLNIATRIMGGQKSGTEYPENLPTMKATVENKDSVLNTATKMKDVQTSTPEEQDLEMASEGEQKRLEEYENNQPQQLDDARNKADNQEKAILNIQARCDARVQNLQAECRKRRLLLEDSKRLVNELNHLKEKERQYEKKQAEREVSIKKNKYFSNFLK

SEQ ID NO: 12297 - protein, 98 aa, Homo sapiens
MGSEELRELRMHRFWYGGTTSFFKSAASSIVKEDKDIFPAGGDHVDNRIIDKWWFHLQHHRNAVVTASFWDLLASLLLKGHTFYRSTSRNRSDLLFRK

SEQ ID NO: 12298 - protein, 224 aa, Homo sapiens; identical to SEQ ID NO: 12295

SEQ ID NO: 12299 - protein, 176 aa, Homo sapiens; identical to SEQ ID NO: 12296

SEQ ID NO: 12300 - protein, 99 aa, Homo sapiens
MTSGCVVSGKVHCVLANERGRKRHITSYYWLKIAVASGTSARGVPRKLPEQDIAQGSYIALPLTLLVLLAGYNHDKVGNPEASGDGGHVRESESSQLQE

SEQ ID NO: 12301 - protein, 107 aa, Homo sapiens
MDSLTSAKLTLKEADPSSKVAIRRKDSPPPGKVSSQKQPAEKAASDEKDSVSNIATEIKEGPISGTVSSQKQPAEKAASDEKDSVSNIATEIKDGQQSGRHNFAKQI

SEQ ID NO: 12302 - protein, 107 aa, Homo sapiens [sequence omitted]

SEQ ID NO: 12303 - protein, 1905 aa, Homo sapiens
MRRQWGALLLGALLCAHGLASSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAVGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQQDRWIYWTDWQTKSIQRVDKYSGRNKETVLANVEGLMDIIVVSPQRQTGTNACGVNNGGCTHLCFARASDFVCACPDEPDSQPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTEMEQLLQEEQSECSSVHTAATPERRGSLPDTGWKHERKLSSESQV

SEQ ID NO: 12304 - protein, 1462 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 12305 - protein, 1287 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHNQTTTPAATATAPPPVHKVFRK

SEQ ID NO: 12306 - protein, 910 aa, Homo sapiens
MDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 12307 - protein, 195 aa, Homo sapiens
MGSQSSKAPRGDVTAEEAAGASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 12308 - protein, 580 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 12309 - protein, 224 aa, Homo sapiens
MNIEVGNISYTGAIISWSSSEPCLEDYYHIMYRPNWNSIFSGYLRYSFHNEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPLVEMPRKNSRDGAELDPEANQDAPDAGALQRGGGDPPAILPHCGE

SEQ ID NO: 12310 - protein, 149 aa, Homo sapiens
MVFLTAQLWLRNRVTDRYFRIQEVLKHARHFRGRKNRCYRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 12311 - protein, 869 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 12312 - protein, 1375 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAGKSHEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGRNTSQPWNLRCNRDARRY

SEQ ID NO: 12313 - protein, 1429 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 12314 - protein, 1473 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 12315 - protein, 1443 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 12316 - protein, 1399 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 12317 - protein, 837 aa, Homo sapiens
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 12318 - protein, 790 aa, Homo sapiens
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 12319 - protein, 321 aa, Homo sapiens
MSEQSKDLSDPNFAAEAPNSEVHSSPGVSEGVPPSATLAEPQSPPLGPTAAPQAAPPPQAPNDEGDPKALQQAAEEGRAHQAPSAAQPGPAPPAPAQLVQKAHELMWYVLVKDQKKMIIWFPDMVKDVIGSYKKWCRSILRRTSLILARVFGLHLRLTSLHTMEFALVKALEPEELDRVALSNRMPMTGLLLMILSLIYVKGRGARESAVWNVLRILGLRPWKKHSTFGDVRKLITEEFVQMNYLKYQRVPYVEPPEYEFFWGSRASREITKMQIMEFLARVFKKDPQAWPSRYREALEEARALREANPTAHYPRSSVSED

SEQ ID NO: 12320 - protein, 463 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 12321 - protein, 180 aa, Homo sapiens
MRPLTEEETRVMFEKIAKYIGENLQLLVDRPDGTYCFRLHNDRVYYVSEKIMKLAANISGDKLVSLGTCFGKFTKTHKFRLHVTALDYLAPYAKYKVWIKPGAEQSFLYGNHVLKSGLGRITENTSQYQGVVVYSMADIPLGFGVAAKSTQDCRKVDPMAIVVFHQADIGEYVRHEETLT

SEQ ID NO: 12322 - protein, 1222 aa, Homo sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRT

SEQ ID NO: 12323 - protein, 747 aa, Homo sapiens
MSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 12324 - protein, 477 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGFVLFHKIPLDG

SEQ ID NO: 12325 - protein, 227 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 12326 - protein, 651 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 12327 - protein, 603 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 12328 - protein, 592 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 12329 - protein, 640 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 12330 - protein, 741 aa, Homo sapiens
MAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 12331 - protein, 325 aa, Homo sapiens
MLSHADLLDARLGMKDAAELLGHREAVKCRLGVGGSDPGGHPGDLAPNSDPVEGATLLPGEDITTVGSTPASLAVSAKDPDKQPGPQGGPNPSQAGQQQGQQKQKRHRTRFTPAQLNELERSFAKTHYPDIFMREELALRIGLTESRVQVWFQNRRAKWKKRKKTTNVFRAPGTLLPTPGLPQFPSAAAAAAAAMGDSLCSFHANDTRWAAAAMPGVSQLPLPPALGRQQAMAQSLSQCSLAAGPPPNSMGLSNSLAGSNGAGLQSHLYQPAFPGMVPASLPGPSNVSGSPQLCSSPDSSDVWRGTSIASLRRKALEHTVSMSFT

SEQ ID NO: 12332 - protein, 636 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 12333 - protein, 430 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 12334 - protein, 1178 aa, Homo sapiens
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVSEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 12335 - protein, 1178 aa, Homo sapiens; identical to SEQ ID NO: 12334

SEQ ID NO: 12336 - protein, 341 aa, Homo sapiens
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADFGLSKVCSASGQNPEEPVSVNKCFLSTACGTDFYMAPEVWEGHYTAKADIFALGIIIWAMLERITFIDTETKKELLGSYVKQGTEIVPVGEALLENPKMELLIPVKKKSMNGRMKQLIKEMLAANPQDRPDAFELELRLVQIAFKDSSWET

SEQ ID NO: 12337 - protein, 1154 aa, Homo sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELIKGNLQSVGLTLRLVQSTDGYAGHVIIETVAPNSPAAIADLQRGDRLIAIGGVKITSTLQVLKLIKQAGDRVLVYYERPVGQSNQGAVLQDNFGQLEENFLSSSCQSGYEEEAAGLTVDTESRELDSEFEDLASDVRAQNEFKDEAQSLSHSPKRVPTTLSIKPLGAISPVLNRKLAVGSHPLPPKIQSKDGNKPPPLKTSEITDPAQVSKPTQGSAFKPPVPPRPQAKVPLPSADAPNQAEPDVLVEKPEKVVPPPLVDKSAEKQAKNVDAIDDAAAPKQFLAKQEVAKDVTSETSCPTKDSSDDRQTWESSEILYRNKLGKWTRTRASCLFDIEACHRYLNIALWCRDPFKLGGLICLGHVSLKLEDVALGCLATSNTEYLSKLRLEAPSPKAIVTRTALRNLSMQKGFNDKFCYGDITIHFKYLKEGESDHHVVTNVEKEKEPHLVEEVSVLPKEEQFVGQMGLTENKHSFQDTQFQNPTWCDYCKKKVWTKAASQCMFCAYVCHKKCQEKCLAETSVCGATDRRIDRTLKNLRLEGQETLLGLPPRVDAEASKSVNKTTGLTRHIINTSSRLLNLRQVSKTRLSEPGTDLVEPSPKHTPNTSDNEGSDTEVCGPNSPSKRGNSTGIKLVRKEGGLDDSVFIAVKEIGRDLYRGLPTEERIQKLEFMLDKLQNEIDQELEHNNSLVREEKETTDTRKKSLLSAALAKSGERLQALTLLMIHYRAGIEDIETLESLSLDQHSKKISKYTDDTEEDLDNEISQLIDSQPFSSISDDLFGPSESV

SEQ ID NO: 12338 - protein, 364 aa, Homo sapiens
MNRTAMRASQKDFENSMNQVKLLKKDPGNEVKLKLYALYKQATEGPCNMPKPGVFDLINKAKWDAWNALGSLPKEAARQNYVDLVSSLSPSLESSSQVEPGTDRKSTGFETLVVTSEDGITKIMFNRPKKKNAINTEMYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 12339 - protein, 227 aa, Homo sapiens
MYHEIMRALKAASKDDSIITVLTGNGDYYSSGNDLTNFTDIPPGGVEEKAKNNAVLLREFVGCFIDFPKPLIAVVNGPAVGISVTLLGLFDAVYASDRATFHTPFSHLGQSPEGCSSYTFPKIMSPAKATEMLIFGKKLTAGEACAQGLVTEVFPDSTFQKEVWTRLKAFAKLPPNALRISKEVIRKREREKLHAVNAEECNVLQGRWLSDECTNAVVNFLSRKSKL

SEQ ID NO: 12340 - protein, 191 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKGSRTS

SEQ ID NO: 12341 - protein, 1070 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 12342 - protein, 1048 aa, Homo sapiens
MSNKTGGKRPATTNSDIPNHNMVSEVPPERPSVRATRTARKAVAFGKRSHSMKRNPNAPVTKAGWLFKQASSGVKQWNKRWFVLVDRCLFYYKDEKEESILGSIPLLSFRVAAVQPSDNISRKHTFKAEHAGVRTYFFSAESPEEQEAWIQAMGEAARVQIPPAQKSVPQAVRHSHEKPDSENVPPSKHHQQPPHNSLPKPEPEAKTRGEGDGRGCEKAERRPERPEVKKEPPVKANGLPAGPEPASEPGSPYPEGPRVPGGGEQPAQPNGWQYHSPSRPGSTAFPSQDGETGGHRRSFPPRTNPDKIAQRKSSMNQLQQWVNLRRGVPPPEDLRSPSRFYPVSRRVPEYYGPYSSQYPDDYQYYPPGVRPESICSMPAYDRISPPWALEDKRHAFRNGGGPAYQLREWKEPASYGRQDATVWIPSPSRQPVYYDELDAASSSLRRLSLQPRSHSVPRSPSQGSYSRARIYSPVRSPSARFERLPPRSEDIYADPAAYVMRRSISSPKVPPYPEVFRDSLHTYKLNEQDTDKLLGKLCEQNKVVREQDRLVQQLRAEKESLESALMGTHQELEMFGSQPAYPEKLRHKKDSLQNQLINIRVELSQATTALTNSTIEYEHLESEVSALHDDLWEQLNLDTQNEVLNRQIQKEIWRIQDVMEGLRKNNPSRGTDTAKHRGGLGPSATYSSNSPASPLSSASLTSPLSPFSLVSGSQGSPTKPGSNEPKANYEQSKKDPHQTLPLDTPRDISLVPTRQEVEAEKQAALNKVGVVPPRTKSPTDDEVTPSAVVRRNASGLTNGLSSQERPKSAVFPGEGKVKMSVEEQIDRMRRHQSGSMREKRRSLQLPASPAPDPSPRPAYKVVRRHRSIHEVDISNLEAALRAEEPGGHAYETPREEIARLRKMELEPQHYDVDINKELSTPDKVLIPERYIDLEPDTPLSPEELKEKQKKVERIKTLIAKSSMQNVVPIGEGDSVDVPQDSESQLQEQEKRIEISCALATEASRRGRMLSVQCATPSPPTSPASPAPPANPLSSESPRGADSSYTMRV

SEQ ID NO: 12343 - protein, 165 aa, Homo sapiens
MAKMNLSSYILILTFSLFSQGILLSASKSIRNLDDDMVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 12344 - protein, 132 aa, Homo sapiens
MSNKFLGTWKLVSSENFDDYMKALGVGLATRKLGNLAKPTVIISKKGDIITIRTESTFKNTEISFKLGQEFEETTADNRKTKSIVTLQRGSLNQVQRWDGKETTIKRKLVNGKMVAECKMKGVVCTRIYEKV

SEQ ID NO: 12345 - protein, 323 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 12346 - protein, 727 aa, Homo sapiens
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 12347 - protein, 351 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 12348 - protein, 398 aa, Homo sapiens
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 12349 - protein, 383 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 12350 - protein, 418 aa, Homo sapiens
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 12351 - protein, 387 aa, Homo sapiens
MEEIGILVEKAQDEIPALSVSRPQTGLSFLGPEPEDLEDLYSRYKEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 12352 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 12353 - protein, 473 aa, Homo sapiens
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 12354 - protein, 416 aa, Homo sapiens
MVRPRRAPYRSGAGGPLGGRGRPPRPLVVRAVRSRSWPASPRGPQPPRIRARSAPPMEGARVFGALGPIGPSSPGLTLGGLAVSEHRLSNKLLAWSGVLEWQEKRRPYSDSTAKLKRTLPCQAYVNQGENLETDQWPQKLIMQLIPQQLLTTLGPLFRNSQLAQFHFTNRDCDSLKGLCRIMGNGFAGCMLFPHISPCEVRVLMLLYSSKKKIFMGLIPYDQSGFVSAIRQVITTRKQAVGPGGVNSGPVQIVNNKFLAWSGVMEWQEPRPEPNSRSKRWLPSHVYVNQGEILRTEQWPRKLYMQLIPQQLLTTLVPLFRNSRLVQFHFTKDLETLKSLCRIMDNGFAGCVHFSYKASCEIRVLMLLYSSEKKIFIGLIPHDQGNFVNGIRRVIANQQQVLQRNLEQEQQQRGMGG

SEQ ID NO: 12355 - protein, 208 aa, Homo sapiens
MSAGGDFGNPLRKFKLVFLGEQSVGKTSLITRFMYDSFDNTYQATIGIDFLSKTMYLEDRTVRLQLWDTAGQERFRSLIPSYIRDSTVAVVVYDITNLNSFQQTSKWIDDVRTERGSDVIIMLAGNKTDLADKRQITIEEGEQRAKELSVMFIETSAKTGYNVKQLFRRVASALPGMENVQEKSKEGMIDIKLDKPQEPPASEGGCSC

SEQ ID NO: 12356 - protein, 1601 aa, Homo sapiens
MNSPVDPGARQALRKKPPERTPEDLNTIYSYLHGMEILSNLREHQLRLMSARARYERYSGNQVLFCSETIARCWYILLSGSVLVKGSMVLPPCSFGKQFGGKRGCDCLVLEPSEMIVVENAKDNEDSILQREIPARQSRRRFRKINYKGERQTITDDVEVNSYLSLPADLTKMHLTENPHPQVTHVSSSQSGCSIASDSGSSSLSDIYQATESEVGDVDLTRLPEGPVDSEDDEEEDEEIDRTDPLQGRDLVRECLEKEPADKTDDDIEQLLEFMHQLPAFANMTMSVRRELCSVMIFEVVEQAGAIILEDGQELDSWYVILNGTVEISHPDGKVENLFMGNSFGITPTLDKQYMHGIVRTKVDDCQFVCIAQQDYWRILNHVEKNTHKVEEEGEIVMVHEHRELDRSGTRKGHIVIKATPERLIMHLIEEHSIVDPTYIEDFLLTYRTFLESPLDVGIKLLEWFKIDSLRDKVTRIVLLWVNNHFNDFEGDPAMTRFLEEFEKNLEDTKMNGHLRLLNIACAAKAKWRQVVLQKASRESPLQFSLNGGSEKGFGIFVEGVEPGSKAADSGLKRGDQIMEVNGQNFENITFMKAVEILRNNTHLALTVKTNIFVFKELLFRTEQEKSGVPHIPKIAEKKSNRHSIQHVPGDIEQTSQEKGSKKVKANTVSGGRNKIRKILDKTRFSILPPKLFSDGGLSQSQDDSIVGTRHCRHSLAIMPIPGTLSSSSPDLLQPTTSMLDFSNPSDIPDQVIRVFKVDQQSCYIIISKDTTAKEVVFHAVHEFGLTGASDTYSLCEVSVTPEGVIKQRRLPDQFSKLADRIQLNGRYYLKNNMETETLCSDEDAQELVKESQLSMLQLSTIEVATQLSMRDFDLFRNIEPTEYIDDLFKLNSKTGNTHLKRFEDIVNQETFWVASEILTEANQLKRMKIIKHFIKIALHCRECKNFNSMFAIISGLNLASVARLRGTWEKLPSKYEKHLQDLQDIFDPSRNMAKYRNILSSQSMQPPIIPLFPVVKKDMTFLHEGNDSKVDGLVNFEKLRMISKEIRQVVRMTSANMDPAMMFRQRSLSQGSTNSNMLDVQGGAHKKRARRSSLLNAKKLYEDAQMARKVKQYLSSLDVETDEEKFQMMSLQWEPAYGTLTKNLSEKRSAKSSEMSPVPMRSAGQTTKAHLHQPHRVSQVLQVPAVNLHPIRKKGQTKDPALNTSLPQKVLGTTEEISGKKHTEDTISVASSLHSSPPASPQGSPHKGYTLIPSAKSDNLSDSSHSEISSRSSIVSNCSVDSMSAALQDERCSSQALAVPESTGALEKTEHASGIGDHSQHGPGWTLLKPSLIKCLAVSSSVSNEEISQEHIIIEAADSGRGSWTSCSSSSHDNFQSLPNPKSWDFLNSYRHTHLDDPIAEVEPTDSEPYSCSKSCSRTCGQCKGSLERKSWTSSSSLSDTYEPNYGTVKRRVLESTPAESSEGLDPKDATDPVYKTVTSSTEKGLIVYCVTSPKKDDRYREPPPTPPGYLGISLADLKEGPHTHLKPPDYSVAVQRSKMMHNSLSRLPPASLSSNLVACVPSKIVTQPQRHNLQPFHPKLGDVTDADSEADENEQVSAV

SEQ ID NO: 12357 - protein, 193 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 12358 - protein, 230 aa, Homo sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 12359 - protein, 679 aa, Homo sapiens
MGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTFDTDARVAITIYYQATEEFQNGIASYIPKDNSLQSETVQYKRGVCQQFCLPSHTVDPSEWAEEELGFDLDREVYPLVVHAVVDEGDEYFGHCHVLLGTFEKHTDGTFCVKPLKQKQVVDGVSYLLQEIYGIENKYNTQDSKVAEDEVSDNSAECVVCLSDVRDTLILPCRHLCLCNTCADTLRYQANNCPICRLPFRALLQIRAMRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 12360 - protein, 669 aa, Homo sapiens
  MOD_RES 667: Xaa = Selenocysteine
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVTXSS

SEQ ID NO: 12361 - protein, 263 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQSSG

SEQ ID NO: 12362 - protein, 343 aa, Homo sapiens
MDGRRVLGRFWSGWRRGLGVRPVPEDAGFGTEARHQRQPRGSCQRSGPLGDQPFAGLLPKNLSREELVDALRAAVVDRKGPLVTLNKPQGLPVTGKPGELTLFSVLPELSQSLGLREQELQVVRASGKESSGLVLLSSCPQTASRLQKYFTHARRAQRPTATYCAVTDGIPAASEGKIQAALKLEHIDGVNLTVPVKAPSRKDILEGVKKTLSHFRVVATGSGCALVQLQPLTVFSSQLQVHMVLQLCPVLGDHMYSARVGTVLGQRFLLPAENNKPQRQVLDEALLRRLHLTPSQAAQLPLHLHLHRLLLPGTRARDTPVELLAPLPPYFSRTLQCLGLRLQ

SEQ ID NO: 12363 - protein, 330 aa, Homo sapiens
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFERSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 12364 - protein, 201 aa, Homo sapiens
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 12365 - protein, 1217 aa, Homo sapiens
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNFGDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 12366 - protein, 496 aa, Homo sapiens
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEYLAPEVIRKQPYDNTVDWWCLGAVLYEMLYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 12367 - protein, 496 aa, Homo sapiens; identical to SEQ ID NO: 12366

SEQ ID NO: 12368 - protein, 464 aa, Homo sapiens
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL

SEQ ID NO: 12369 - protein, 679 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 12370 - protein, 678 aa, Homo sapiens
MAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 12371 - protein, 503 aa, Homo sapiens
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12372 - protein, 489 aa, Homo sapiens
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12373 - protein, 366 aa, Homo sapiens
MQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12374 - protein, 469 aa, Homo sapiens
MLCLCLYVPVIGEAQTEFQYFESKGLPAELKSIFKLSVFIPSQEFSTYRQWKQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 12375 - protein, 533 aa, Homo sapiens
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTVSKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 12376 - protein, 685 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKIRIRLSTNSADKGSKVDTSGIFLDKGEGLIFEHNTKNLLHRQTAFRDRCFVSNRACYSSVLNILYTSC

SEQ ID NO: 12377 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 12378 - protein, 925 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIHIKVIDDEAYEKNKNYFIEMMGPRMVDMSFQKALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 12379 - protein, 924 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 12380 - protein, 921 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 12381 - protein, 620 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVCDRQEADYGRRGGQEDSRDGKASIG

SEQ ID NO: 12382 - protein, 927 aa, Homo sapiens
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 12383 - protein, 589 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQISYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 12384 - protein, 536 aa, Homo sapiens
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 12385 - protein, 350 aa, Homo sapiens
MKPLVLLVALLLWPSSVPAYPSITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKHPESWNNDDILKKILDINSQVQQALLSDTSNPAYREDIEASKDHLKRSLALAAAAEHKLKTMYKSQLLPVGRTSNKIDDIETVINMLCNSRSKLYEYLDIKCVPPEMREKAATVFNTLKNMCRSRRVTALLKVY

SEQ ID NO: 12386 - protein, 440 aa, Homo sapiens
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 12387 - protein, 317 aa, Homo sapiens
MNNTAASPMSTATSSSGRSTGKSISFATELQSMMYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 12388 - protein, 328 aa, Homo sapiens
MVVFGTTFFNFDSFIGKTDSIEIIGKSVFPYCYHNILPLLNDSGRYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 12389 - protein, 421 aa, Homo sapiens
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSLSIEDTFESISELGPLELMGRELDLAPYGTLRKSQSADSLNSISSVSNTFGQDFTLGQVEVSMEYDTASHTLNVAVMQGKDLLEREEASFESCFMRVSLLPDEQIVGISRIQRNAYSIFFDEKFSIPLDPTALEEKSLRFSVFGIDEDERNVSTGVVELKLSVLDLPLQPFSGWLYLQDQNKAADAVGEILLSLSYLPTAERLTVVVVKAKNLIWTNDKTTADPFVKVYLLQDGRKMSKKKTAVKRDDPNPVFNEAMIFSVPAIVLQDLSLRVTVAESSSDGRGDNVGHVIIGPSASGMGTTHWNQMLATLRRPVSMWHAVRRN

SEQ ID NO: 12390 - protein, 337 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGK

SEQ ID NO: 12391 - protein, 345 aa, Homo sapiens
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 12392 - protein, 366 aa, Homo sapiens
MSEEEQGSGTTTGCGLPSIEQMLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 12393 - protein, 345 aa, Homo sapiens; identical to SEQ ID NO: 12391

SEQ ID NO: 12394 - protein, 260 aa, Homo sapiens
MVWPALWELYRELGLFQGPALGLRNHLGRKLRRRKKKKAKRTTNWKIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 12395 - protein, 2155 aa, Homo sapiens
MNYSSFLRIWVSFIFALVQHQAQPRELMYPFWQNDTKTPKVDDGSSSEIKLAIPVFFFGVPYRTVYVNNNGVVSFNVLVSQFTPESFPLTDGRAFVAPFWADVHNGIRGEIYYRETMEPAILKRATKDIRKYFKDMATFSATWVFIVTWEEVTFYGGSSTTPVNTFQAVLVSDGSYTFTLFNYYEINWTTGTASGGDPLTGLGGVMAQAGFNGGNLTNFFSLPGSRTPEIVNIQETTNVNVPGRWAFKVDGKEIDPANGCTSRGQFLRRGEVFWDDLNCTVKCRCLDFNNEIYCQEASCSPYEVCEPKGKFFYCSAVETSTCVVFGEPHYHTFDGFLFHFQGSCAYLLARQCLQTSSLPFFSVEAKNEHRGGSAVSWVKELSVEVNGYKILIPKGSYGRVKVNDLVTSLPVTLDLGTVKIYQSGISTAVETDFGLLVTFDGQHYASISVPGSYINSTCGLCGNYNKNPLDDFLRPDGRPAMSVLDLGESWRVYHADWKCDSGCVDNCTQCDAATEALYFGSDYCGFLNKTDGPLWECGTVVDPTAFVHSCVYDLCSVRDNGTLLCQAIQAYALVCQALGIPIGDWRTQTGCVSTVQCPSFSHYSVCTSSCPDTCSDLTASRNCATPCTEGCECNQGFVLSTSQCVPLHKCGCDFDGHYYTMGEFFWATANCTVQCLCEEGGDVYCFNKTCGSGEVCAVEDGYQGCFPKRETVCLLSQNQVLHTFDGASYAFPSEFSYTLLKTCPERPEYLEIDINKKKPDAGPAWLRGLRILVADQEVKIGGIGASEVKLNGQEVELPFFHPSGKLEIYRNKNSTTVESKGVVTVQYSDIGLLYIRLSTTYFNCTGGLCGFYNANASDEFCLPNGKCTDNLAVFLESWTTFEEICNGECGDLLKACNNDSELLKFYRSRSRCGIINDPSNSSFLECHGVVNATAYYRTCLFRLCQSGGNESELCDSVARYASACKNADVEVGPWRTYDFCPLECPENSHFEECITCTETCETLTLGPICVDSCSEGCQCDEGYALLGSQCVTRSECGCNFEGHQLATNETFWVDLDCQIFCYCSGTDNRVHCETIPCKDDEYCMEEGGLYYCQARTDASCIVSGYGHYLTFDGFPFDFQTSCPLILCTTGSRPSSDSFPKFVVTAKNEDRDPSLALWVKQVDVTVFGYSIVIHRAYKHTVLVNSERLYLPLKLGQGKINIFSFGFHVVVETDFGLKVVYDWKTFLSITVPRSMQNSTYGLCGRYNGNPDDDLEMPMGLLASSVNEFGQSWVKRDTFCQVGCGDRCPSCAKVEGFSKVQQLCSLIPNQNAAFSKCHSKVNPTFFYKNCLFDSCIDGGAVQTACSWLQNYASTCQTQGITVTGWRNYTSCTVTCPPNSHYESCVSVCQPRCAAIRLKSDCSHYCVEGCHCDAGYVLNGKSCILPHSCGCYSDGKYYEPKQLFWNSDCTRRCRCFRRNVIQCDPRQCKSDEECALRNGVRGCFSTKTSYCLAAGGGVFRTFDGAFLRFPANCAFVLSTICQKLPDISFQLIINFDKWSAPNLTIISPVYFYINEEQILINDRNTVKVNGTQVNVPFITGLATKIYSSEGFLVIDTSPDIQIYYNGFNVIKISISERLQNKVCGLCGNFNGDLTDDYVTLRGKPVVSSVVLAQSWKTNGMQKRPLAPSCNELQFSQYAAMCDNVHIQKMQGDGYCLKLTDMKGFFQPCYGLLDPLPFYESCYLDGCYNHKKFQLCGSLAAYGEACRSFGILSTEWIEKENCSGVVEDPCVGADCPNRTCELGNGRELCGCIEPPPYGNNSHDIIDAEVTCKAAQMEVSISKCKLFQLGFEREGVRINDRQCTGIEGEDFISFQINNTKGNCGNIVQSNGTHIMYKNTLWIESANNTGNIITRDRTINVEFSCAYELDIKISLDSVVKPMLSVINLTVPTQEGSFITKMALYKNASYKHPYRQGEVVLTTRDVLYVGVFVVGADATHLILTLNKCYATPTRDSNDKLRYFIIEGGCQNLKDNTIGIEENAVSLTCRFHVTVFKFIGDYDEVHLHCAVSLCDSEKYSCKITCPHNSRIATDYTKEPKEQIISVGPIRRKRLDWCEDNGGCEQICTSRVDGPLCSCVTGTLQEDGKSCRASNSSMELQVWTLLLIMIQISLWHFVYKSGTTS

SEQ ID NO: 12396 - protein, 95 aa, Homo sapiens
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 12397 - protein, 623 aa, Homo sapiens
MESYHKPDQQKLQALKDTANRLRISSIQATTAAGSGHPTSCCSAAEIMAVLFFHTMRYKSQDPRNPHNDRFVLSKGHAAPILYAVWAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 12398 - protein, 1078 aa, Homo sapiens
MFGAASRMDTTAVCTGGVTESRGIVDSLQKFSSLPAYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVSNNCDSIFVNGKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 12399 - protein, 443 aa, Homo sapiens
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 12400 - protein, 186 aa, Homo sapiens
MGLMMVGVLIGTFIAHVVCKRLLTAWVAARIQSSEKLSAVIRVVEGGSGLKVVALARLTPIPFGLQNAVFSITDLSLPNYLMASSVGLLPTQLLNSYLGTTLRTMEDVIAEQSVSGYFVFCLQIIISIGLMFYVVHRAQVELNAAIVACEMELKSSLVKGNQPNTSGSSFYNKRTLTFSGGGINVV

SEQ ID NO: 12401 - protein, 257 aa, Homo sapiens
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVTKNAVQALIDKHQRIPGNIMSALLERFH

SEQ ID NO: 12402 - protein, 1360 aa, Homo sapiens
MASDSPARSLDEIDLSALRDPAGIFELVELVGNGTYGQVYKGRHVKTGQLAAIKVMDVTGDEEEEIKQEINMLKKYSHHRNIATYYGAFIKKNPPGMDDQLWLVMEFCGAGSVTDLIKNTKGNTLKEEWIAYICREILRGLSHLHQHKVIHRDIKGQNVLLTENAEVKLVDFGVSAQLDRTVGRRNTFIGTPYWMAPEVIACDENPDATYDFKSDLWSLGITAIEMAEGAPPLCDMHPMRALFLIPRNPAPRLKSKKWSKKFQSFIESCLVKNHSQRPATEQLMKHPFIRDQPNERQVRIQLKDHIDRTKKKRGEKDETEYEYSGSEEEEEENDSGEPSSILNLPGESTLRRDFLRLQLANKERSEALRRQQLEQQQRENEEHKRQLLAERQKRIEEQKEQRRRLEEQQRREKELRKQQEREQRRHYEEQMRREEERRRAEHEQEYIRRQLEEEQRQLEILQQQLLHEQALLLEYKRKQLEEQRQAERLQRQLKQERDYLVSLQHQRQEQRPVEKKPLYHYKEGMSPSEKPAWAKEVEERSRLNRQSSPAMPHKVANRISDPNLPPRSESFSISGVQPARTPPMLRPVDPQIPHLVAVKSQGPALTASQSVHEQPTKGLSGFQEALNVTSHRVEMPRQNSDPTSENPPLPTRIEKFDRSSWLRQEEDIPPKVPQRTTSISPALARKNSPGNGSALGPRLGSQPIRASNPDLRRTEPILESPLQRTSSGSSSSSSTPSSQPSSQGGSQPGSQAGSSERTRVRANSKSEGSPVLPHEPAKVKPEESRDITRPSRPASYKKAIDEDLTALAKELRELRIEETNRPMKKVTDYSSSSEESESSEEEEEDGESETHDGTVAVSDIPRLIPTGAPGSNEQYNVGMVGTHGLETSHADSFSGSISREGTLMIRETSGEKKRSGHSDSNGFAGHINLPDLVQQSHSPAGTPTEGLGRVSTHSQEMDSGTEYGMGSSTKASFTPFVDPRVYQTSPTDEDEEDEESSAAALFTSELLRQEQAKLNEARKISVVNVNPTNIRPHSDTPEIRKYKKRFNSEILCAALWGVNLLVGTENGLMLLDRSGQGKVYNLINRRRFQQMDVLEGLNVLVTISGKKNKLRVYYLSWLRNRILHNDPEVEKKQGWITVGDLEGCIHYKVVKYERIKFLVIALKNAVEIYAWAPKPYHKFMAFKSFADLQHKPLLVDLTVEEGQRLKVIFGSHTGFHVIDVDSGNSYDIYIPSHIQGNITPHAIVILPKTDGMEMLVCYEDEGVYVNTYGRITKDVVLQWGEMPTSVAYIHSNQIMGWGEKAIEIRSVETGHLDGVFMHKRAQRLKFLCERNDKVFFASVRSGGSSQVFFMTLNRNSMMNW

SEQ ID NO: 12403 - protein, 253 aa, Homo sapiens
MAAATRGCRPWGSLLGLLGLVSAAAAAWDLASLRCTLGAFCECDFRPDLPGLECDLAQHLAGQHLAKALVVKALKAFVRDPAPTKPLVLSLHGWTGTGKSYVSSLLAHYLFQGGLRSPRVHHFSPVLHFPHPSHIERYKKDLKSWVQGNLTACGRSLFLFDEMDKMPPGLMEVLRPFLGSSWVVYGTNYRKAIFIFIRWGPALQWAQCGGHFSEVQLYSLSLCSQQNPVPHGLSWAFPVPSATLRDDIVIPPG

SEQ ID NO: 12404 - protein, 220 aa, Homo sapiens
MFQRLSSLFFSTPSPPEDPDCPRAFVSEEDEVDGWLIIDLPDSYAAPPSPGAAPAPAGRPPPAPSLMDESWFVTPPACFTAEGPGLGPARLQSSPLEDLLIEHPSMSVYVTGSTIVLEPGSPSPLPDAALPDGDLSEGELTPARREPRAARHAAPLPARAALLEKAGQVRRLQRARQRAERHALSAKAVQRQNRARESRPRRSKNQSSFIYQPCQRQFNY

SEQ ID NO: 12405 - protein, 717 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 12406 - protein, 1118 aa, Homo sapiens
MSVEAYGPSSQTLTFLDTEEAELLGADTQGSEFEFTDFTLPSQTQTPPGGPGGPGGGGAGGPGGAGAGAAAGQLDAQVGPEGILQNGAVDDSVAKTSQLLAELNFEEDEEDTYYTKDLPIHACSYCGIHDPACVVYCNTSKKWFCNGRGNTSGSHIVNHLVRAKCKEVTLHKDGPLGETVLECYNCGCRNVFLLGFIPAKADSVVVLLCRQPCASQSSLKDINWDSSQWQPLIQDRCFLSWLVKIPSEQEQLRARQITAQQINKLEELWKENPSATLEDLEKPGVDEEPQHVLLRYEDAYQYQNIFGPLVKLEADYDKKLKESQTQDNITVRWDLGLNKKRIAYFTLPKTDSDMRLMQGDEICLRYKGDLAPLWKGIGHVIKVPDNYGDEIAIELRSSVGAPVEVTHNFQVDFVWKSTSFDRMQSALKTFAVDETSVSGYIYHKLLGHEVEDVIIKCQLPKRFTAQGLPDLNHSQVYAVKTVLQRPLSLIQGPPGTGKTVTSATIVYHLARQGNGPVLVCAPSNIAVDQLTEKIHQTGLKVVRLCAKSREAIDSPVSFLALHNQIRNMDSMPELQKLQQLKDETGELSSADEKRYRALKRTAERELLMNADVICCTCVGAGDPRLAKMQFRSILIDESTQATEPECMVPVVLGAKQLILVGDHCQLGPVVMCKKAAKAGLSQSLFERLVVLGIRPIRLQVQYRMHPALSAFPSNIFYEGSLQNGVTAADRVKKGFDFQWPQPDKPMFFYVTQGQEEIASSGTSYLNRTEAANVEKITTKLLKAGAKPDQIGIITPYEGQRSYLVQYMQFSGSLHTKLYQEVEIASVDAFQGREKDFIILSCVRANEHQGIGFLNDPRRLNVALTRARYGVIIVGNPKALSKQPLWNHLLNYYKEQKVLVEGPLNNLRESLMQFSKPRKLVNTINPGARFMTTAMYDAREAIIPGSVYDRSSQGRPSSMYFQTHDQIGMISAGPSHVAAMNIPIPFNLVMPPMPPPGYFGQANGPAAGRGTPKGKTGRGGRQKNRFGLPGPSQTNLPNSQASQDVASQPFSQGALTQGYISMSQPSQMSQPGLSQPELSQDSYLGDEFKSQIDVALSQDSTYQGERAYQHGGVTGLSQY

SEQ ID NO: 12407 - protein, 670 aa, Homo sapiens
MMEEEELEFVEELEAVLQLTPEVQLAIEQVFPSQDPLDRADFNAVEYINTLFPTEQSLANIDEVVNKIRLKIRRLDDNIRTVVRGQTNVGQDGRQVKEITRDIKQLDHAKRHLTTSITTLNHLHMLAGGVDSLEAMTRRRQYGEVANLLQGVMNVLEHFHKYMGIPQIRQLSERVKAAQTELGQQILADFEEAFPSQGTKRPGGPSNVLRDACLVANILDPRIKQEIIKKFIKQHLSEYLVLFQENQDVAWLDKIDRRYAWIKRQLVDYEEKYGRMFPREWCMAERIAVEFCHVTRAELAKIMRTRAKEIEVKLLLFAIQRTTNFEGFLAKRFSGCTLTDGTLKKLESPPPSTNPFLEDEPTPEMEELATEKGDLDQPKKPKAPDNPFHGIVSKCFEPHLYVYIESQDKNLGELIDRFVADFKAQGPPKPNTDEGGAVLPSCADLFVYYKKCMVQCSQLSTGEPMIALTTIFQKYLREYAWKILSGNLPKTTTSSGGLTISSLLKEKEGSEVAKFTLEELCLICNILSTAEYCLATTQQLEEKLKEKVDVSLIERINLTGEMDTFSTVISSSIQLLVQDLDAACDPALTAMSKMQWQNVEHVGDQSPYVTSVILHIKQNVPIIRDNLASTRKYFTQFCVKFANSFIPKFITHLFKCKPISMVGAEQVRWT

SEQ ID NO: 12408 - protein, 265 aa, Homo sapiens
MEALPPVRSSLLGNLLQVTRLSVLLVQNRDHLYNFLLLKINLFNHWVSGLAQEARGSCNWQAHLPLGAADCPLGQALRAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETPRE

SEQ ID NO: 12409 - protein, 440 aa, Homo sapiens
MPIPPPPPPPPGPPPPPTFHQANTEQPKLSRDEQRGRGALLQDICKGTKLKKVTNINDRSAPILEKPKGSSGGYGSGGAALQPKGGLFQGGVLKLRPVGAKDGSENLAGKPALQIPSSRAAAPRPPVSAASGRPQDDTDSSRASLPELPRMQRPSLPDLSRPNTTSSTGMKHSSSAPPPPPPGRRANAPPTPLPMHSSKAPAYNREKPLPPTPGQRLHPGREGPPAPPPVKPPPSPVNIRTGPSGQSLAPPPPPYRQPPGVPNGPSSPTNESAPELPQRHNSLHRKTPGPVRGLAPPPPTSASPSLLSNRPPPPARDPPSRGAAPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 12410 - protein, 273 aa, Homo sapiens
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 12411 - protein, 902 aa, Homo sapiens
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHQPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 12412 - protein, 488 aa, Homo sapiens
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 12413 - protein, 473 aa, Homo sapiens
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 12414 - protein, 615 aa, Homo sapiens
MAERALEPEAEAEAEAGAGGEAAAEEGAAGRKARGRPRLTESDRARRRLESRKRYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQCEICGYQCRQRASLNWHMKKHTAEVQYNFTCDRCGKRFEKLDSVKFHTLKSHPDHKPT

SEQ ID NO: 12415 - protein, 146 aa, Homo sapiens
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSETASCVHGCPV

SEQ ID NO: 12416 - DNA, 17 bp, Homo sapiens
gatctcactgcaaggac

SEQ ID NO: 12417 - DNA, 17 bp, Homo sapiens
gatcctctggaccatga

SEQ ID NO: 12418 - DNA, 17 bp, Homo sapiens
gatccaaactcctccaa

SEQ ID NO: 12419 - DNA, 17 bp, Homo sapiens
gatcagcccaaagttgt

SEQ ID NO: 12420 - DNA, 17 bp, Homo sapiens
gatccgcttttaaacag

SEQ ID NO: 12421 - DNA, 17 bp, Homo sapiens
gatccatcaataaccaa

SEQ ID NO: 12422 - DNA, 17 bp, Homo sapiens
gatccacctggctaaca

SEQ ID NO: 12423 - DNA, 17 bp, Homo sapiens
gatcctcagattcctta

SEQ ID NO: 12424 - DNA, 17 bp, Homo sapiens
gatcttaagaaacacaa

SEQ ID NO: 12425 - DNA, 17 bp, Homo sapiens
gatctttcaagtttcac

SEQ ID NO: 12426 - DNA, 17 bp, Homo sapiens
gatcagaagcaaatgtg

SEQ ID NO: 12427 - DNA, 17 bp, Homo sapiens
gatcaagtacaagagtc

SEQ ID NO: 12428 - DNA, 17 bp, Homo sapiens
gatctaaagacctgaag

SEQ ID NO: 12429 - DNA, 17 bp, Homo sapiens
gatcgccgcctccgaag

SEQ ID NO: 12430 - DNA, 17 bp, Homo sapiens
gatccagcttccatttg

SEQ ID NO: 12431 - DNA, 17 bp, Homo sapiens
gatcacttcaagactcc

SEQ ID NO: 12432 - DNA, 17 bp, Homo sapiens
gatcagcagacccgaca

SEQ ID NO: 12433 - DNA, 17 bp, Homo sapiens
gatctgcttcagtagga

SEQ ID NO: 12434 - DNA, 17 bp, Homo sapiens
gatcagatttgggagga

SEQ ID NO: 12435 - DNA, 17 bp, Homo sapiens
gatccccagacagagtc

SEQ ID NO: 12436 - DNA, 17 bp, Homo sapiens
gatcggtgccactggtc

SEQ ID NO: 12437 - DNA, 17 bp, Homo sapiens
gatccaaaatttttctc

SEQ ID NO: 12438 - DNA, 17 bp, Homo sapiens
gatccaaacccactggc

SEQ ID NO: 12439 - DNA, 17 bp, Homo sapiens
gatcttactaggaaaaa

SEQ ID NO: 12440 - DNA, 17 bp, Homo sapiens
gatctctttatgttaaa

SEQ ID NO: 12441 - DNA, 17 bp, Homo sapiens
gatcataaatcgaaaac

SEQ ID NO: 12442 - DNA, 17 bp, Homo sapiens
gatcttaatttttgtgt

SEQ ID NO: 12443 - DNA, 17 bp, Homo sapiens
gatccccctgccatggc

SEQ ID NO: 12444 - DNA, 17 bp, Homo sapiens
gatccgtttattttaat

SEQ ID NO: 12445 - DNA, 17 bp, Homo sapiens
gatctcatgctgctttc

SEQ ID NO: 12446 - DNA, 17 bp, Homo sapiens
gatctctacccagaaat

SEQ ID NO: 12447 - DNA, 17 bp, Homo sapiens
gatcacgccactccatt

SEQ ID NO: 12448 - DNA, 17 bp, Homo sapiens
gatctgtagctttccct

SEQ ID NO: 12449 - DNA, 17 bp, Homo sapiens
gatctgtggactttgct

SEQ ID NO: 12450 - DNA, 17 bp, Homo sapiens
gatcaggagaaagataa

SEQ ID NO: 12451 - DNA, 17 bp, Homo sapiens
gatcaacgaagtttggc

SEQ ID NO: 12452 - DNA, 17 bp, Homo sapiens
gatcgccaggctgttcc

SEQ ID NO: 12453 - DNA, 17 bp, Homo sapiens
gatccaaatttgttatc

SEQ ID NO: 12454 - DNA, 17 bp, Homo sapiens
gatcacgacactacact

SEQ ID NO: 12455 - DNA, 17 bp, Homo sapiens
gatcgtgtcactgcaat

SEQ ID NO: 12456 - DNA, 17 bp, Homo sapiens
gatctgtaggacaaacc

SEQ ID NO: 12457 - DNA, 17 bp, Homo sapiens
gatctgtacgagaaaaa

SEQ ID NO: 12458 - DNA, 17 bp, Homo sapiens
gatcagaactacattaa

SEQ ID NO: 12459 - DNA, 17 bp, Homo sapiens
gatctgtttaaaaacca

SEQ ID NO: 12460 - DNA, 17 bp, Homo sapiens
gatcaacttcttaggtg

SEQ ID NO: 12461 - DNA, 17 bp, Homo sapiens
gatcagtttctgtcaaa

SEQ ID NO: 12462 - DNA, 17 bp, Homo sapiens
gatcttttgcaaaaatg

SEQ ID NO: 12463 - DNA, 17 bp, Homo sapiens
gatctgaggctgaggta

SEQ ID NO: 12464 - DNA, 17 bp, Homo sapiens
gatctgacagggggagg

SEQ ID NO: 12465 - DNA, 17 bp, Homo sapiens
gatcttgtaaaaatagc

SEQ ID NO: 12466 - DNA, 17 bp, Homo sapiens
gatcctctttccccact

SEQ ID NO: 12467 - DNA, 17 bp, Homo sapiens
gatccttgaacacttcg

SEQ ID NO: 12468 - DNA, 17 bp, Homo sapiens
gatccccagagtcctag

SEQ ID NO: 12469 - DNA, 17 bp, Homo sapiens
gatcgctcaggcctcct

SEQ ID NO: 12470 - DNA, 17 bp, Homo sapiens
gatcagaggaggcccta

SEQ ID NO: 12471 - DNA, 17 bp, Homo sapiens
gatcagcctcgcccctg

SEQ ID NO: 12472 - DNA, 17 bp, Homo sapiens
gatcagtcctctgcagt

SEQ ID NO: 12473 - DNA, 17 bp, Homo sapiens
gatccagcgccagccac

SEQ ID NO: 12474 - DNA, 17 bp, Homo sapiens
gatctccttcgccggcc

SEQ ID NO: 12475 - DNA, 17 bp, Homo sapiens
gatccatatacgagcgt

SEQ ID NO: 12476 - DNA, 17 bp, Homo sapiens
gatccctatccatttgc

SEQ ID NO: 12477 - DNA, 17 bp, Homo sapiens
gatcacaccacctttct

SEQ ID NO: 12478 - DNA, 17 bp, Homo sapiens
gatccaaacacaattct

SEQ ID NO: 12479 - DNA, 17 bp, Homo sapiens
gatccagtctatcttta

SEQ ID NO: 12480 - DNA, 17 bp, Homo sapiens
gatccatattttactgg

SEQ ID NO: 12481 - DNA, 17 bp, Homo sapiens
gatcatcaattttctgt

SEQ ID NO: 12482 - DNA, 17 bp, Homo sapiens
gatccaggcatcccata

SEQ ID NO: 12483 - DNA, 17 bp, Homo sapiens
gatcattacgaaattga

SEQ ID NO: 12484 - DNA, 17 bp, Homo sapiens
gatcctaattttgtaaa

SEQ ID NO: 12485 - DNA, 17 bp, Homo sapiens
gatcacttgatagttct

SEQ ID NO: 12486 - DNA, 17 bp, Homo sapiens
gatcatttataataccc

SEQ ID NO: 12487 - DNA, 17 bp, Homo sapiens
gatccccgctggccagc

SEQ ID NO: 12488 - DNA, 17 bp, Homo sapiens
gatcgagaccatctcca

SEQ ID NO: 12489 - DNA, 17 bp, Homo sapiens
gatctattatcaagaac

SEQ ID NO: 12490 - DNA, 17 bp, Homo sapiens
gatctcccttcccttgt

SEQ ID NO: 12491 - DNA, 17 bp, Homo sapiens
gatctgaattgtacgca

SEQ ID NO: 12492 - DNA, 17 bp, Homo sapiens
gatctgtttctgattca

SEQ ID NO: 12493 - DNA, 17 bp, Homo sapiens
gatccctgatgaggatt

SEQ ID NO: 12494 - DNA, 17 bp, Homo sapiens
gatctatttcatctatt

SEQ ID NO: 12495 - DNA, 17 bp, Homo sapiens
gatctcagtgtcagagc

SEQ ID NO: 12496 - DNA, 17 bp, Homo sapiens
gatcacctcctgcttgc

SEQ ID NO: 12497 - DNA, 17 bp, Homo sapiens
gatcagaaatatcaatc

SEQ ID NO: 12498 - DNA, 17 bp, Homo sapiens
gatccgtcctggactct

SEQ ID NO: 12499 - DNA, 17 bp, Homo sapiens
gatcgtatctcaaaaaa

SEQ ID NO: 12500 - DNA, 17 bp, Homo sapiens
gatctatcatcctaaaa

SEQ ID NO: 12501 - DNA, 17 bp, Homo sapiens
gatcccagaaggacctc

SEQ ID NO: 12502 - DNA, 17 bp, Homo sapiens
gatccagttaatcctct

SEQ ID NO: 12503 - DNA, 17 bp, Homo sapiens
gatcctgatggctactg

SEQ ID NO: 12504 - DNA, 17 bp, Homo sapiens
gatcatatcacctagta

SEQ ID NO: 12505 - DNA, 17 bp, Homo sapiens
gatcctcatctgcttca

SEQ ID NO: 12506 - DNA, 17 bp, Homo sapiens
gatcatttcgtagtaca

SEQ ID NO: 12507 - DNA, 17 bp, Homo sapiens
gatcagccttatgttcc

SEQ ID NO: 12508 - DNA, 17 bp, Homo sapiens
gatcactttccaaatgt

SEQ ID NO: 12509 - DNA, 17 bp, Homo sapiens
gatcccggggaagccgc

SEQ ID NO: 12510 - DNA, 17 bp, Homo sapiens
gatctccctcaccaacc

SEQ ID NO: 12511 - DNA, 17 bp, Homo sapiens
gatctcctccccttgga

SEQ ID NO: 12512 - DNA, 17 bp, Homo sapiens
gatctgagtcgttcttc

SEQ ID NO: 12513 - DNA, 17 bp, Homo sapiens
gatccacaattaatcgt

SEQ ID NO: 12514 - DNA, 17 bp, Homo sapiens
gatccagatgggttcag

SEQ ID NO: 12515 - DNA, 17 bp, Homo sapiens
gatctctgttgcaacta

SEQ ID NO: 12516 - DNA, 17 bp, Homo sapiens
gatcatggctcaaggca

SEQ ID NO: 12517 - DNA, 17 bp, Homo sapiens
gatctgtatttatttca

SEQ ID NO: 12518 - DNA, 17 bp, Homo sapiens
gatctgctgataaggac

SEQ ID NO: 12519 - DNA, 17 bp, Homo sapiens
gatccaggaacctgttc

SEQ ID NO: 12520 - DNA, 17 bp, Homo sapiens
gatcgagcgcatggtgc

SEQ ID NO: 12521 - DNA, 17 bp, Homo sapiens
gatctgtgtttgtgtgt

SEQ ID NO: 12522 - DNA, 17 bp, Homo sapiens
gatccatagtaaaaaag

SEQ ID NO: 12523 - DNA, 17 bp, Homo sapiens
gatccctccccctccct

SEQ ID NO: 12524 - DNA, 17 bp, Homo sapiens
gatctcatcactttatt

SEQ ID NO: 12525 - DNA, 17 bp, Homo sapiens
gatcaagctggacttgc

SEQ ID NO: 12526 - DNA, 17 bp, Homo sapiens
gatctgacgattgacaa

SEQ ID NO: 12527 - DNA, 17 bp, Homo sapiens
gatctgtatgcagggta

SEQ ID NO: 12528 - DNA, 17 bp, Homo sapiens
gatcttcatcaaagaga

SEQ ID NO: 12529 - DNA, 17 bp, Homo sapiens
gatccccgccaagacca

SEQ ID NO: 12530 - DNA, 17 bp, Homo sapiens
gatcctcaaactcctgg

SEQ ID NO: 12531 - DNA, 17 bp, Homo sapiens
gatcccctgtggacagg

SEQ ID NO: 12532 - DNA, 17 bp, Homo sapiens
gatcagaatggtcccaa

SEQ ID NO: 12533 - DNA, 17 bp, Homo sapiens
gatcttcctcctctgtt

SEQ ID NO: 12534 - DNA, 17 bp, Homo sapiens
gatccagctcagcctcc

SEQ ID NO: 12535 - DNA, 17 bp, Homo sapiens
gatcatttgcaacgcca

SEQ ID NO: 12536 - DNA, 17 bp, Homo sapiens
gatcgcaggcataagct

SEQ ID NO: 12537 - DNA, 17 bp, Homo sapiens
gatctttcggttgcagc

SEQ ID NO: 12538 - DNA, 17 bp, Homo sapiens
gatcatttcttcagccc

SEQ ID NO: 12539 - DNA, 17 bp, Homo sapiens
gatcccacagaattaca

SEQ ID NO: 12540 - DNA, 17 bp, Homo sapiens
gatccttacaaataaca

SEQ ID NO: 12541 - DNA, 17 bp, Homo sapiens
gatccaggaggtggagg

SEQ ID NO: 12542 - DNA, 17 bp, Homo sapiens
gatctttggcaagagcc

SEQ ID NO: 12543 - DNA, 17 bp, Homo sapiens
gatctgctaatgaattc

SEQ ID NO: 12544 - DNA, 17 bp, Homo sapiens
gatcttcttgcatcttt

SEQ ID NO: 12545 - DNA, 17 bp, Homo sapiens
gatccttgtgcgatgtc

SEQ ID NO: 12546 - DNA, 17 bp, Homo sapiens
gatccttccccctttcc

SEQ ID NO: 12547 - DNA, 17 bp, Homo sapiens
gatcttagccaaattac

SEQ ID NO: 12548 - DNA, 17 bp, Homo sapiens
gatcacgaacctgactg

SEQ ID NO: 12549 - DNA, 17 bp, Homo sapiens
gatcctagagaccatca

SEQ ID NO: 12550 - DNA, 17 bp, Homo sapiens
gatcccaacaacacaat

SEQ ID NO: 12551 - DNA, 17 bp, Homo sapiens
gatcttctgacattagt

SEQ ID NO: 12552 - DNA, 17 bp, Homo sapiens
gatcacccacctgcccc

SEQ ID NO: 12553 - DNA, 17 bp, Homo sapiens
gatccaccattggcaca

SEQ ID NO: 12554 - DNA, 17 bp, Homo sapiens
gatcaaatagaacagag

SEQ ID NO: 12555 - DNA, 17 bp, Homo sapiens
gatcctaaggactattt

SEQ ID NO: 12556 - DNA, 17 bp, Homo sapiens
gatccagtgttggagag

SEQ ID NO: 12557 - DNA, 17 bp, Homo sapiens
gatcagagactgataca

SEQ ID NO: 12558 - DNA, 17 bp, Homo sapiens
gatcaccttcgaacagc

SEQ ID NO: 12559 - DNA, 17 bp, Homo sapiens
gatccgaaagtagcggt

SEQ ID NO: 12560 - DNA, 17 bp, Homo sapiens
gatcacagaacataagt

SEQ ID NO: 12561 - DNA, 17 bp, Homo sapiens
gatccagaatccactgc

SEQ ID NO: 12562 - DNA, 17 bp, Homo sapiens
gatctaagatgggtggg

SEQ ID NO: 12563 - DNA, 17 bp, Homo sapiens
gatctctgtggtttgca

SEQ ID NO: 12564 - DNA, 17 bp, Homo sapiens
gatctacgccattttca

SEQ ID NO: 12565 - DNA, 17 bp, Homo sapiens
gatccctgcgcgtgccc

SEQ ID NO: 12566 - DNA, 17 bp, Homo sapiens
gatccttagtttgcagc

SEQ ID NO: 12567 - DNA, 17 bp, Homo sapiens
gatcatttcaagctctt

SEQ ID NO: 12568 - DNA, 17 bp, Homo sapiens
gatctggaatgccctcc

SEQ ID NO: 12569 - DNA, 17 bp, Homo sapiens
gatcatgagcaggaggc

SEQ ID NO: 12570 - DNA, 17 bp, Homo sapiens
gatctacttctccaaat

SEQ ID NO: 12571 - DNA, 17 bp, Homo sapiens
gatctgaaaccccattt

SEQ ID NO: 12572 - DNA, 17 bp, Homo sapiens
gatcagcatctgttttt

SEQ ID NO: 12573 - DNA, 17 bp, Homo sapiens
gatcttccagcatatct

SEQ ID NO: 12574 - DNA, 17 bp, Homo sapiens
gatcctggtttattaag

SEQ ID NO: 12575 - DNA, 17 bp, Homo sapiens
gatccacctgtaactga

SEQ ID NO: 12576 - DNA, 17 bp, Homo sapiens
gatctgggcctggtgcc

SEQ ID NO: 12577 - DNA, 17 bp, Homo sapiens
gatccaggcatttcact

SEQ ID NO: 12578 - DNA, 17 bp, Homo sapiens
gatccttcaggactggg

SEQ ID NO: 12579 - DNA, 17 bp, Homo sapiens
gatcccagagaggaaca

SEQ ID NO: 12580 - DNA, 17 bp, Homo sapiens
gatctgctgcggggccg

SEQ ID NO: 12581 - DNA, 17 bp, Homo sapiens
gatctgtttggggaaca

SEQ ID NO: 12582 - DNA, 17 bp, Homo sapiens
gatctcattttcataca

SEQ ID NO: 12583 - DNA, 17 bp, Homo sapiens
gatccagggtcccccag

SEQ ID NO: 12584 - DNA, 17 bp, Homo sapiens
gatcaggaagtttcttc

SEQ ID NO: 12585 - DNA, 17 bp, Homo sapiens
gatcttgtaattcggta

SEQ ID NO: 12586 - DNA, 17 bp, Homo sapiens
gatcatctcatgttttc

SEQ ID NO: 12587 - DNA, 17 bp, Homo sapiens
gatctgtttcctctatc

SEQ ID NO: 12588 - DNA, 17 bp, Homo sapiens
gatccttttcaccagag

SEQ ID NO: 12589 - DNA, 17 bp, Homo sapiens
gatctctctgagtcctt

SEQ ID NO: 12590 - DNA, 17 bp, Homo sapiens
gatcctttccgcgactc

SEQ ID NO: 12591 - DNA, 17 bp, Homo sapiens
gatcaaggaataactca

SEQ ID NO: 12592 - DNA, 17 bp, Homo sapiens
gatctcactgttcttat

SEQ ID NO: 12593 - DNA, 17 bp, Homo sapiens
gatccatggtccttcag

SEQ ID NO: 12594 - DNA, 17 bp, Homo sapiens
gatcccagctacttgtg

SEQ ID NO: 12595 - DNA, 17 bp, Homo sapiens
gatctataatatgtata

SEQ ID NO: 12596 - DNA, 17 bp, Homo sapiens
gatcagaacttggtgcc

SEQ ID NO: 12597 - DNA, 17 bp, Homo sapiens
gatctgtagctttccca

SEQ ID NO: 12598 - DNA, 17 bp, Homo sapiens
gatcaatactttgattt

SEQ ID NO: 12599 - DNA, 17 bp, Homo sapiens
gatcttaggtttaaaaa

SEQ ID NO: 12600 - DNA, 17 bp, Homo sapiens
gatcccgtctctactaa

SEQ ID NO: 12601 - DNA, 17 bp, Homo sapiens
gatcattgccctccctg

SEQ ID NO: 12602 - DNA, 17 bp, Homo sapiens
gatcatactgatagttt

SEQ ID NO: 12603 - DNA, 17 bp, Homo sapiens
gatccactgaaatttca

SEQ ID NO: 12604 - DNA, 17 bp, Homo sapiens
gatctcatcctgagcct

SEQ ID NO: 12605 - DNA, 17 bp, Homo sapiens
gatctggggcttctcca

SEQ ID NO: 12606 - DNA, 17 bp, Homo sapiens
gatcatgaaaaggtaca

SEQ ID NO: 12607 - DNA, 17 bp, Homo sapiens
gatctggactgggcctg

SEQ ID NO: 12608 - DNA, 17 bp, Homo sapiens
gatcctgcttcctctct

SEQ ID NO: 12609 - DNA, 17 bp, Homo sapiens
gatcccgttgttgacgc

SEQ ID NO: 12610 - DNA, 17 bp, Homo sapiens
gatccatcccgctattc

SEQ ID NO: 12611 - DNA, 17 bp, Homo sapiens
gatcagaatagcaaaaa

SEQ ID NO: 12612 - DNA, 17 bp, Homo sapiens
gatcaggagaaatgctc

SEQ ID NO: 12613 - DNA, 17 bp, Homo sapiens
gatctgaagtctgctct

SEQ ID NO: 12614 - DNA, 17 bp, Homo sapiens
gatcttcagcagtacca

SEQ ID NO: 12615 - DNA, 17 bp, Homo sapiens
gatcccatgagatggaa

SEQ ID NO: 12616 - DNA, 17 bp, Homo sapiens
gatcgccaaaaagaaaa

SEQ ID NO: 12617 - DNA, 17 bp, Homo sapiens
gatctgggtagcggatg

SEQ ID NO: 12618 - DNA, 17 bp, Homo sapiens
gatccatgatactcttt

SEQ ID NO: 12619 - DNA, 17 bp, Homo sapiens
gatcactttatattttg

SEQ ID NO: 12620 - DNA, 17 bp, Homo sapiens
gatcaagcacaggtttt

SEQ ID NO: 12621 - DNA, 17 bp, Homo sapiens
gatctttggaatttaca

SEQ ID NO: 12622 - DNA, 17 bp, Homo sapiens
gatccaaataaggtact

SEQ ID NO: 12623 - DNA, 17 bp, Homo sapiens
gatcccagagatataat

SEQ ID NO: 12624 - DNA, 17 bp, Homo sapiens
gatccaaagagatagat

SEQ ID NO: 12625 - DNA, 17 bp, Homo sapiens
gatcataccatgaacca

SEQ ID NO: 12626 - DNA, 17 bp, Homo sapiens
gatctgccttatggagg

SEQ ID NO: 12627 - DNA, 17 bp, Homo sapiens
gatctctccagctactt

SEQ ID NO: 12628 - DNA, 17 bp, Homo sapiens
gatcttcaggttctcgt

SEQ ID NO: 12629 - DNA, 17 bp, Homo sapiens
gatctctattttaacat

SEQ ID NO: 12630 - DNA, 17 bp, Homo sapiens
gatcccccaccctaccc

SEQ ID NO: 12631 - DNA, 17 bp, Homo sapiens
gatcaagcatctacgag

SEQ ID NO: 12632 - DNA, 17 bp, Homo sapiens
gatcttcctcccgttta

SEQ ID NO: 12633 - DNA, 17 bp, Homo sapiens
gatcttgccttttcttc

SEQ ID NO: 12634 - DNA, 17 bp, Homo sapiens
gatcctccgatggacca

SEQ ID NO: 12635 - DNA, 17 bp, Homo sapiens
gatcgcctgaggtgggg

SEQ ID NO: 12636 - DNA, 17 bp, Homo sapiens
gatcctcaaaagatacc

SEQ ID NO: 12637 - DNA, 17 bp, Homo sapiens
gatcccgaggtgggtgg

SEQ ID NO: 12638 - DNA, 17 bp, Homo sapiens
gatctcttcctcagtga

SEQ ID NO: 12639 - DNA, 17 bp, Homo sapiens
gatccagagaaatgcct

SEQ ID NO: 12640 - DNA, 17 bp, Homo sapiens
gatcgagcagaagtatg

SEQ ID NO: 12641 - DNA, 17 bp, Homo sapiens
gatctgttgacagtccc

SEQ ID NO: 12642 - DNA, 17 bp, Homo sapiens
gatctctgtttccgcag

SEQ ID NO: 12643 - DNA, 17 bp, Homo sapiens
gatctaagcttaggaat

SEQ ID NO: 12644 - DNA, 17 bp, Homo sapiens
gatcaggcagcagtgtt

SEQ ID NO: 12645 - DNA, 17 bp, Homo sapiens
gatctggctcattttat

SEQ ID NO: 12646 - DNA, 17 bp, Homo sapiens
gatccttggtggtccct

SEQ ID NO: 12647 - DNA, 17 bp, Homo sapiens
gatctgcactttcacct

SEQ ID NO: 12648 - DNA, 17 bp, Homo sapiens
gatctttttcttctttc

SEQ ID NO: 12649 - DNA, 17 bp, Homo sapiens
gatcaactgcgtggcgt

SEQ ID NO: 12650 - DNA, 17 bp, Homo sapiens
gatcatagcatactaca

SEQ ID NO: 12651 - DNA, 17 bp, Homo sapiens
gatcagtaatcgaaaac

SEQ ID NO: 12652 - DNA, 17 bp, Homo sapiens
gatcatttgtaaaaata

SEQ ID NO: 12653 - DNA, 17 bp, Homo sapiens
gatctgttgcataatag

SEQ ID NO: 12654 - DNA, 17 bp, Homo sapiens
gatctgctcgccacccg

SEQ ID NO: 12655 - DNA, 17 bp, Homo sapiens
gatccttctggtggggg

SEQ ID NO: 12656 - DNA, 17 bp, Homo sapiens
gatccagaggctggctc

SEQ ID NO: 12657 - DNA, 17 bp, Homo sapiens
gatcactttaatgacca

SEQ ID NO: 12658 - DNA, 17 bp, Homo sapiens
gatcacagcagccagtc

SEQ ID NO: 12659 - DNA, 17 bp, Homo sapiens
gatcgaacctgtcgctt

SEQ ID NO: 12660 - DNA, 17 bp, Homo sapiens
gatcaatttcctcgttt

SEQ ID NO: 12661 - DNA, 17 bp, Homo sapiens
gatctgactggaggaag

SEQ ID NO: 12662 - DNA, 17 bp, Homo sapiens
gatcaaattatatttga

SEQ ID NO: 12663 - DNA, 17 bp, Homo sapiens
gatccaatcaactggaa

SEQ ID NO: 12664 - DNA, 17 bp, Homo sapiens
gatcaaagaaaagaaaa

SEQ ID NO: 12665 - DNA, 17 bp, Homo sapiens
gatctgtatgtaagtga

SEQ ID NO: 12666 - DNA, 17 bp, Homo sapiens
gatccccccagttatta

SEQ ID NO: 12667 - DNA, 17 bp, Homo sapiens
gatcctccttccttagt

SEQ ID NO: 12668 - DNA, 17 bp, Homo sapiens
gatcatgtgccgccgca

SEQ ID NO: 12669 - DNA, 17 bp, Homo sapiens
gatctcactgaaaataa

SEQ ID NO: 12670 - DNA, 4872 bp, Homo sapiens
tattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacat

SEQ ID NO: 12671 - DNA, 4450 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12672 - DNA, 4420 bp, Homo sapiens
agccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgaagacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcatccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagatctcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12673 - DNA, 7042 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaaaaaaaa

SEQ ID NO: 12674 - DNA, 7171 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaaaaaaaa

SEQ ID NO: 12675 - DNA, 7204 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaaaaaaaa

SEQ ID NO: 12676 - DNA, 7075 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaaaaaaaa

SEQ ID NO: 12677 - DNA, 4559 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaaaaaaaa

SEQ ID NO: 12678 - DNA, 1831 bp, Homo sapiens
ggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgaaaaggctattacccattgaagaaaagaaagaaaaatttaagaaagcaatgaccatcggagatgtttcattggtccaggagctcctagattctggcattagtgtagattccaactttcagtatggatggactccccttatgtatgctgctagtgttgccaatgcagagctggttcgggtccttttggacagaggtgctaatgcaagctttgagaaggataagcaaagtattttgataactgcatgttctgctcatggctcagaggaacagatcttgaagtgtgtagaactactactttcaagaaatgctgatccaaatgttgcttgtaggagacttatgaccccaatcatgtatgctgctcgagatggtcacacccaggttgttgctctccttgttgctcatggagcagaagttaatacccaggatgagaatggttacactgctttaacgtgggcagcacgtcagggtcataaaaatatagttttgaagttgcttgaacttggagctaataaaatgctacaaaccaaagatggaaagatgccaagtgagattgcaaaaagaaacaaacatcatgagatcttcaacttactttcttttactttaaatccattggaaggaaaacttcaacagctaactaaagaagacactatttgtaaaatattgacaacagattctgatagagaaaaagatcacatttttagttcatatacagcatttggagatctggaagtatttttacatggtcttggacttgaacatatgacagatttactaaaggaaagggatataacgttaagacatcttttgaccatgagggaagatgaatttacaaagaatggaattaccagtaaagaccagcagaaaattctggctgctcttaaagaactacaggtagaagagatacaatttggagagctatctgaagagacaaagttggaaatcagtggtgatgagttcctcaactttcttctcaaattaaataaacagtgtggccatttaataacagctgtacagaatgttattactgagttacctgtaaattctcaaaagataacactggaatgggcttctccccagaattttacttcagtttgtgaagaattggttaataatgttgaagatttgagtgaaaaggtctgcaaactaaaagacctaattcaaaagttgcaaaatgaacgggaaaatgatccaactcatatacaattaagggaagaagtatctacatggaatagtagaattttgaagaggacagctattaccatatgcggattcggttttcttcttttcatttgcaagctaactttccagaggaaataatccaaatatttgttttaagttatatatacacatcttattgaaccatccaaaaatcattgcttttaactgtttgcagcacaatataactttacattctttgccaatattccataggaaaaattttgacaatgtggagtttttttttaaaaagtggtttgttactttgacttataaatacaatttgttatgtttatgttaattgtgattaggtagtaaagtataagtaattttttggtttgatcgtatctaaatcacattcaaaattaaagttatatctaatatctttgacattttttaaagtgtgttcatttgtcagtgaatcgtacaggatttgtaaagtgttcataaattgagctttcttttgtttctttttt

SEQ ID NO: 12679 - DNA, 2488 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 12680 - DNA, 6644 bp, Homo sapiens
ttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggaaattggctttcatgcttccctggcccagagaaaccccaacgctcatcacttggaccacaagatggaaataaagcagtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggcacccattcagcagctggctgaccggtttagtggatattttgtcccatttatcatcatcatgtcaactttgacgttggtggtatggattgtaatcggttttatcgattttggtgttgttcagagatactttcctaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaa

SEQ ID NO: 12681 - DNA, 6023 bp, Homo sapiens
ttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaaatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctgaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacaatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgagagcaaaacctcagaagccctggctaaactcatgtctctccaagccacagaagccaccgttgtgacccttggtgaggacaatttaatcatcagggaggagcaagtccccatggagctggtgcagcggggcgatatcgtcaaggtggtccctgggggaaagtttccagtggatgggaaagtcctggaaggcaataccatggctgatgagtccctcatcacaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagaaatgatttgctggatgtggtggctagcattcacctttccaagaggactgtccgaaggatacgcatcaacctggtcctggcactgatttataacctggttgggatacccattgcagcaggtgtcttcatgcccatcggcattgtgctgcagccctggatgggctcagcggccatggcagcctcctctgtgtctgtggtgctctcatccctgcagctcaagtgctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaaaa

SEQ ID NO: 12682 - DNA, 987 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 12683 - DNA, 2188 bp, Homo sapiens
ctcgcggtaagaggctgaggagccggcctgcaacctgccggsscggctccgctacggcagcgcctcagtggcttcctccacagccacctccggagggatctggctgaggaggaagtggaggtgtcactggccccggcctttgccccaatcttgtgtgggcactgaagggggactacaggttcgagagttatgggtgctacatgtgtgctttcagagcagtagtgtgaggaagcttggagtgggatggcaggacggcctcatccctatgatggtaactccagtgatccagagaattgggatcggaaattgcatagtagacctcgtaaactttataaacattcaagtacttcctcgcgtattgctaaaggaggagttgaccacaccaaaatgagtctacatggtgctagtgggggacatgagagatcaagagatagacgaaggtcaagtgacagatcacgagattcatctcatgaaagaacggagtcccagctcactccttgtattagaaatgtgacttctccaacacgacagcaccatgttgaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggatgtttggatctggccgagaacataactttacacgacccaatgagaaaggagagtatgaggtggcagagggaattggttccactgtgtttcgagcgattctggattactataaaacaggaataatccgttgtcctgatggcatatctattcctgaactgagagaagcatgtgactatctttgtatctcttttgaatatagcactattaaatgtagagatctcagtgccctaatgcatgagttatcaaatgatggtgctcgtagacaatttgaattttatctggaagaaatgatcctccctctcatggtagctagtgcccagagtggggaacgggaatgtcatatagtggtgcttacagatgatgatgtggttgattgggatgaagaatatccaccacagatgggagaagaatattcacaaattatttatagcacaaaattatatagatttttcaagtatattgaaaacagagatgtggccaagtcagttttgaaggagaggggtcttaagaagattagattgggaatagaaggttatcctacctacaaagaaaaagtaaagaaaaggcctggaggccgcccagaagtgatctacaactatgtccaaagaccctttattcgaatgtcctgggagaaggaagaaggaaagagtcggcatgtagactttcagtgtgtaaagagtaaatctatcaccaatcttgcagcagctgcagcagacattccccaggaccagctggtagtcatgcatccaactccacaagtggatgagctggatattctccctatccaccccccttctggcaacagtgacctcgatcctgatgcacagaatccaatgctgtgatgctgatcttccttgaaaccatagcatgctactcttcacagtgacgttgtactctcctcattctgcactgcaaggccactcttcttcattgtgagatgcacataacaatgtttaggatattgcagtgtaggcttttttaaagaccaaaggtagctgaatggtttttttttaaatgagtacaactctagcattttgaagttccagttgtaaatgtatttgtttaccagtaggtttgtgaaattggttctttgtatgggggatggtcctttttcacacagctaggtcttttcagaagtggtggaaattggcagctggggtactttcagtttggactgatattcatcacacctcagataaaatgcagagtaatatatagttgcactttataaatggtggttaaatggaaatgttcaagccattttatagttgtgatgcacaatataatttaagtgcttctgtcaaagtattcctccagtacaatttgtatagtttgctgcccttgatgagcaaaaagtat

SEQ ID NO: 12684 - DNA, 1366 bp, Homo sapiens
cagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctgaaaaaaaaaaaaaaaaaaaaaaaaaaaaaaaaaaaaaaacaaaagag

SEQ ID NO: 12685 - DNA, 2635 bp, Homo sapiens
gcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgggtttgatatgctggtgaagaatagaacccaaggaatcattcctttggcccccatatctaaatcattgtggccttgctcagtagaatcttccatggaatattgtagaataatgtatgatatatttcctttcaaaaagccggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttaccggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaggatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattgaaatatttgaaatgc

SEQ ID NO: 12686 - DNA, 1685 bp, Homo sapiens
agctctgaagagagaaaagcggcggtgtcctgcggagagagccgctccctccactgcccgaggggagcgcgtcgcctcagccgctcgaaagcaggaaatgggcggcaaaagcgcagtcagacaccaactggttctggactgcccccgagaggcagcgagcagcgctcccgcgcttcgcccgctaggagctgccgccacgtcccgagctgcgccgctcgcgcccctccctgctccgagtccccggtgggggctgggctgcggccgagtccggtacccgggcccccacccgcgccgcgctgtcgaacccgccgccggcccgctctcggcgccgataatcgccggcgggcatcccgcagaggctgccgccggctccgccaaacagcagccaaggcatagccgggaagtccccaggccacccgttccccagcacccttcggggaattcccgttcagctctacaggaggcgaaaacggaacaaacgaaaaccccttaacagtgaaaccgggcccggcgatggcccgggtggcgactgcgacgactcgacgcgtgcggacacaagacccgtctcgcgctccgctgctcctgtgcgtccggacgaaccttagagatcacttaaggaggctcgcgcgctactcctcaccacgtgaccgccccgccaggccgccccccgcgccgccatcttacatccgggacagaggcggcgtcccctttccctgccttggcaggcgtcagcgtgctaccagaaatcagccctgaaagaggggaccccgattccacgtcaccagagtgctgaggcagcgggcgatgccctccatcggctcagcgggggggagtggagtcccaaacttttttcggcctttgcccgcaaagaagatggcggcgcatatcgccgcctaagcggacacgttgtaccctggccgtggtttgaagtttccggcacctcctttcccaaccagcaaggacacaaccatacgagccccacccacgcggggtggctgccgtgctacattccgcagaaaacaggcgggaaagctgcggcacagcccgctttaaacgcaagcttttgggacttctggttttggctttttctttttaagccaagttagggagaaggctgactgccatggagccacttctgcttttggcccagacaacttacgggattttttttttcctcccatttagagattttttgtaggaagttaacaaattattttaaagaagtagttagggcttgtcagataaaatacaggacgcccagttaaattggaatttcagataaccagtgttttggcatatgtgtgttacatatatttttaaaattgtttatctgatattccaatttaactgcacattctcaatttttaatgactgtatctggcaaccctatcagcctttacccctgaaaatccagactgcttatgacaaaagtaaggaatggagggaaatgaaaagcatgtttacctacaacttagaattgtctttgcccagactttgatccttcatggaggccagagggccgtggtctagaacaaaatttggcagcaactcataaagatatccttgtataattccctttctggcaaagtaagattttttttttcttaagctatcacgatgtaattttggacaacagatcctcttggccaagagtttaattgcaaattaaaaattaaataactggc

SEQ ID NO: 12687 - DNA, 4454 bp, Homo sapiens
gtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatttaaaagaaagcttggaacaatcaatcgaccaactccggagtcaacgtttattgagaaactcaggagggagaagtatttctgttacaagtttgagtgcaagtgaccttgatggtggcactgggtcagagctccatcattttccacctacctcacctctcaaggactatggggatccacagggtattaaacgaatgagatcaagaactggtgtccggtttgttcaagagactgatgatatgactcagcttcatggttttcatcagtctcttcgagacctcagcagtgaacaaattcgccttggagatgatttcaacagggagctttccagaaggagccggtcagatgccgaaacaaaaagggctttggaagaattgactgaaaaacttaatgaagcccagaaacaagaagtggtttcagatcgggtggagcggcggcttcaggaactggagagagagatgcgcacagaaagggagctggtggaaagacgccaggatcaactgggactcatgtccctgcagctacaggaggcactaaagaaacaagaagctaaagcagatgagcatgagggggcaataaaaaataagctaagacaaactgaaactgagaagaatcaacttgaacaggaattggagctatctcgaaggttattgaatcaatcagaaggcagccgagaaacacttttgcatcaggtagaagaactgcgtacacaacttacgaaagcagaaggtgatcgaaagggtttacagcatcaagtatctcagatttccaagcaacagtcaaactatcaggatgaacaaggggaggactggagatttaggagaggggttgagcgggaaaaacaggacctggagaagcaaatgtcagatttgagagtgcagctgaacttcagcgcaatggcatctgagttagaggaagtgaaacggtgcatggagagaaaagacaaggagaaagcacatttggcatcacaagtagagaatttaacacgtgaactggagaatggggaaaaacagcaactgcagatgttggatcgacttaaggagatccagaatcactttgacacatgtgaggccgagcgtaagcatgctgaccttcagatctcagagctgactcgccatgcggaggatgcaaccaagcaggctgagcggtacctcagtgagctccagcagtcagaggctctgaaagaggaggcggagaagaggagggaagacctgaaactgaaagctcaagaatccattaggcagtggaagcttaagcataagaagttagaacgagcgttggagaaacaatctgaaactgttgatgaactgacaggcaagaataatcagattttaaaagaaaaggatgaattgaaaacccagctgtatgcagcattacaacaaatagagaatcttcgaaaggaattgaatgatgtcctaacaaagcgtgcccttcaggaggaggagcttcactccaaggaggagaaattacgtgatattaagtctcatcaagctgaccttgaattggaagttaagaattccctggataccatccatagactggagagcgaattgaaaaagcagagtaagatccaaagccagatgaaagttgagaaagctcacttggaggaagaaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtgcctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaattttctccctaataaattatcatgtgttataacatgtggagatgtgcatatataacattagacagtccactttataaatgctcaggacttttatatctatcatcttaacagtccacaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactgaatcctattgggtcatggattctgcatagacaagggcaataaagcaatacctttgtaatatg

SEQ ID NO: 12688 - DNA, 2143 bp, Homo sapiens
gagacagggtttcagtatgttggccaggctggtcttgaactcctgacctcaagtgatctgcccgcctcggcctcccaaagtgctgggattacaggaatttagtgattgacaatggcagaaaaaatcctagagaagttggatgtccttgataagcaagcagagataatcttggccagaagaacaaagataaacaggcttcagagtgaaggaagaaaaacaactatggctatacccctgacatttgattttcagttggaatttgaagaagctcttgctacatccgcgtctaaggcaatatcaaagatcaaagaagacaagtcatgcagcattacaaaatcaaaaatgcatgtctctttcaaatgtgagcctgaacctagaaagagtaattttgaaaagtcaaatttaagaccattctttattcaaacaaatgtaaaaaataaagaaagtgagtcaacagctcaaattgaaaaaaaacctaggaaaccattggattctgttggtctcttagaaggtgatagaaataaaagaaaaaaatctccacagatgaacgattttaatataaaagaaaacaaatcggtcagaaattatcaattaagtaagtataggtcagtaagaaagaaaagcttgctcccgttgtgctttgaggatgaattgaaaaatccacatgccaagatagtcaacgttagtccaacaaagacagtaacttctcacatggaacaaaaggacacaaatcccataattttccatgacacagaatatgtacgaatgttacttttgacaaaaaatagattttcttctcatcctttggaaaatgaaaacatttacccacataaaagaacaaatttcattttagaaagaaattgtgaaatcctcaaatctataattggcaatcaatctatttctcttttcaaaccccaaaaaactatgcctacagtacagagaaaagatatacagatccctatgtcttttaaagcgggccacacaactgtagatgataaactaaagaagaaaactaataagcagacactagaaaacagatcttggaatacactctataatttctcacagaatttttctagcctaacaaaacaatttgtgggttaccttgataaagctgttattcatgaaatgagtgcccaaactggaaaatttgaaagaatgttttctgcaggaaaaccaacgagcatacccacatccagtgccttacctgtcaaatgttactcaaagccttttaaatatatatatgaactaaataatgtaacgccactggataatttgttaaacttatcaaatgaaattttaaatgcctcataaaatattatgtatgcagcaatatttgagtaacaagaagcaaatatccaagttccaaaattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaatctaaataattttggtagcaaatcctataaggtattaaacattttaaggtatattattacattgctattttactgtttctcattaacccaaacagtttaaaggcagaattccacttagaaacaagttgcattttgaaagtttatttgtaatccatttgtttggaattcagaaatgtatttcacataaaaataatcttggaagtaataaattccaaaatt

SEQ ID NO: 12689 - DNA, 2872 bp, Homo sapiens
gggggagggaggaggccttggagaaggaggagggaaaaaggggctgtgggatttagtggctgggctgcaccccctgggggggcagcagagcccaatgggccagaagggccacaaagactccctttacccttgtggagggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgacctgttgtgtatgcgttagattcttcagttaagagaaaagagatatttaagtgataaaatttatgcccttaagggatcgtgcatcatgtatttcaataaaatatgtgttgcatgaatccttaggccaggcagaaagtcttga

SEQ ID NO: 12690 - DNA, 2789 bp, Homo sapiens
ccatggcctttctgaccacctggaaggaggcggcctccgggaaaagcgaccgcaggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgacctgttgtgtatgcgttagattcttcagttaagagaaaagagatatttaagtgataaaatttatgcccttaagggatcgtgcatcatgtatttcaataaaatatgtgttgcatgaatccttaggccaggcagaaagtcttga

SEQ ID NO: 12691 - DNA, 1800 bp, Homo sapiens
ggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaagagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgacctgttgtgtatgcgttagattcttcagttaagagaaaagagatatttaagtgataaaatttatgcccttaagggatcgtgcatcatgtatttcaataaaatatgtgttgcatgaatccttaggccaggcagaaagtcttga

SEQ ID NO: 12692 - DNA, 1929 bp, Homo sapiens
gcagtcacatggcaggccgttagggcagagggagctgggcagggcacagcagggcaggagtgtgtttgatgtgtcctgggaaccgccctgaggccgtcgtgtggctggagtgctgcaggtgtcaaggaaattgtaggagatgtctcctgagtgtgatggaatataaccagatttccagaaggaactgacatgatctgacttaaaaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgacctgttgtgtatgcgttagattcttcagttaagagaaaagagatatttaagtgataaaatttatgcccttaagggatcgtgcatcatgtatttcaataaaatatgtgttgcatgaatccttaggccaggcagaaagtcttga

SEQ ID NO: 12693 - DNA, 2248 bp, Homo sapiens
ggggacagagaactaagtcttgttcctgcatggagtgggggaaggtttcctacgggaggggacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgacctgttgtgtatgcgttagattcttcagttaagagaaaagagatatttaagtgataaaatttatgcccttaagggatcgtgcatcatgtatttcaataaaatatgtgttgcatgaatccttaggccaggcagaaagtcttga

SEQ ID NO: 12694 - DNA, 2856 bp, Homo sapiens
cgcccggctcggggttgcggcggcagcacctgggccgcgattggcgtccggctggggcagcgccgcccgcgcccctcggcgatgacctcggctggcggcgccccaggagccctgcccgcggggactcctgagagcagcctccatgaggccctggaccagtgcatgaccgccctggacctcttcctcaccaaccagttctcagaagcactcagctacctcaagcccagaaccaaggaaagcatgtaccactcactgacatatgccaccatcctggagatgcaggccatgatgacctttgaccctcaggacatcctgcttgccggcaacatgatgaaggaggcacagatgctgtgtcagaggcaccggaggaagtcttctgtaacagattccttcagcagcctggtgaaccgccccacgctgggccaattcactgaagaggaaatccacgctgaggtctgctatgcagagtgcctgctgcagcgagcagccctgaccttcctgcaggacgagaacatggtgagcttcatcaaaggcggcatcaaagttcgaaacagctaccagacctacaaggagctggacagccttgttcagtcctcacaatactgcaagggtgagaaccacccgcactttgaaggaggagtgaagcttggtgtaggggccttcaacctgacactgtccatgcttcctactaggatcctgaggctgttggagtttgtggggttttcaggaaacaaggactatgggctgctgcagctggaggagggagcgtcagggcacagcttccgctctgtgctctgtgtcatgctcctgctgtgctaccacaccttcctcaccttcgtgctcggtactgggaacgtcaacatcgaggaggccgagaagctcttgaagccctacctgaaccggtaccctaagggtgccatcttcctgttctttgcagggaggattgaagtcattaaaggcaacattgatgcagccatccggcgtttcgaggagtgctgtgaggcccagcagcactggaagcagttccaccacatgtgctactgggagctgatgtggtgcttcacctacaagggccagtggaagatgtcctacttctacgccgacctgctcagcaaggagaactgctggtccaaggccacctacatttacatgaaggccgcctacctcagcatgtttgggaaggaggaccacaagccgttcggggacgacgaagtggaattatttcgagctgtgccaggcctgaagctcaagattgctgggaaatctctacccacagagaagtttgccatccggaagtcccggcgctacttctcctccaaccctatctcgctgccagtgcctgctctggaaatgatgtacatctggaacggctacgccgtgattgggaagcagccgaaactcacggatgggatacttgagattatcactaaggctgaagagatgctggagaaaggcccagagaacgagtactcagtggatgacgagtgcttggtgaaattgttgaaaggcctgtgtctgaaatacctgggccgtgtccaggaggccgaggagaattttaggagcatctctgccaatgaaaagaagattaaatatgaccactacttgatcccaaacgccctgctggagctggccctgctgcttatggagcaagacagaaacgaagaggccatcaaacttttggaatctgccaagcaaaactacaagaattactccatggagtcaaggacacactttcgaatccaggcagccacactccaagccaagtcttccctagagaacagcagcagatccatggtctcatcagtgtccttgtagctttgtgcagcagttccgggctggaagacagagacagctggacagagctcctgaaaacatttcaaaataccccctccccctgccctgccctgcctttggggtccaccggcactccagttggatggcacaacatagtgtatccgtgcagaagccgagctggcattttcaccagtgtagccaagggcctttgccaagggcagagcaggtggagccctctgcctgccctatcacacatacgggtacttgcttttcactgtgatgtttaagagaatgtatgaacagtttacattttccttagaaatacattgatgggatcacagttggctttaaaaaccaacaacaatcaaccacctgtaagtctttgtcttcacctattatcatctggaggtaaatctctttatatgatgatgccaaagggcaaattgcttttcaaattcagcaagttctcagcttgtgtgacggaaggtccttcagaggacctgaggaatgcctgggagaggctaagcctcaggcttcaatgcttctggggttgggcatgaggatgtacacagacacccactaccttactactcacacttcatttcactccttttgtaaatttccaatttaaaaatcaagcacgtctttttagtgagataaaatctgagctcttctgtagaaaaatcaatctctaccagtagaaaatgccagggcttgatggaagagctgtgtagccctttctatgccaaagccaggaaatttggggggcaggaggaggttctcagaatccagtctgtatctttgctgtatgccaaactgaaaccactgggaataatttatgaaacataaaaatcttctgtacttcactccaaggtacatttgcttactgacagcatttttgttaaaactgttattcttgacctgttgtgtatgcgttagattcttcagttaagagaaaagagatatttaagtgataaaatttatgcccttaagggatcgtgcatcatgtatttcaataaaatatgtgttgcatgaatccttaggccaggcagaaagtcttga

SEQ ID NO: 12695 - DNA, 2789 bp, Homo sapiens; identical to SEQ ID NO: 12690

SEQ ID NO: 12696 - DNA, 2872 bp, Homo sapiens; identical to SEQ ID NO: 12689

SEQ ID NO: 12697 - DNA, 1800 bp, Homo sapiens; identical to SEQ ID NO: 12691

SEQ ID NO: 12698 - DNA, 1929 bp, Homo sapiens; identical to SEQ ID NO: 12692

SEQ ID NO: 12699 - DNA, 2248 bp, Homo sapiens; identical to SEQ ID NO: 12693

SEQ ID NO: 12700 - DNA, 2856 bp, Homo sapiens; identical to SEQ ID NO: 12694

SEQ ID NO: 12701 - DNA, 1031 bp, Homo sapiens
cctactcgcacagcccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacatgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccaaaaaaaaaaaaaaaaaaaaaaaaaaaaaaaaaaaaaaaaaaa

SEQ ID NO: 12702 - DNA, 1270 bp, Homo sapiens
ctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacaaaaaaaaaaaaaaaaaa

SEQ ID NO: 12703 - DNA, 2663 bp, Homo sapiens
gatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagtcccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgcggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttt

SEQ ID NO: 12704 - DNA, 2901 bp, Homo sapiens
cttcctcacgagaataaacacacattttactctcacctgccacttcccctactatccattgttagagtccttcactcccaaatttcgccgcagactcccgcccagtctcactcaccattggttgggaaagctacgaagctccgcctttgaatagtgatgggctataaaagacggcacctttgagggaaaaggcagtaggtcaggcgctcacctttgcctgctctctggcaacagtgctcacagtttctgagccagtggaggtggcctggagcagcagcccatgctactctctgccggttattttgccatttctctgtgcccttttgacagctccagggatcggtgccagcatttgtactgccagttcaggcacctgcagatctggtggaaaagtgagggaggtgattgcagttgcttggagatgctccaggtgcaaaggagttgtgttgagtccacagcaggagccttactggtgctggaaaagcaagtcctcctgatctacctccctactgccaaaggaacctaggatcagttcctacggactggctgtgacgggaaagaagcaccagcactcgccttagaactagcagccaagtccatctaaagtgaccaggagccttttgggtggtccctcagttcctgaaacactgggttgtagagggaagctgtcccagagatgtttggaaaggtggttggcttgggcaggcgtcaagagcatctcttccatccctcaggaggagcgggcaccagctccccagtaaccgaaagaactgctgggcctgcggggctccacggtgccccagtcctagacataactatggaaaaattagaacagaaaaaatgagttagtcaaggctgaggttgaagaagagcagaagaggatctccaaatgaactttagcacttgaagaactgactcaaagccctgtggcctccttgaatgacacaaatgtgaggcaagattttcctgaaaatagcctgctcccagaggaaaagtgaattgcaccatcaaagaacaaagacagactggaaagtatgtgatggacctcagatgtccagagactgatcttgaatatgatcctttcctcaattattctgcggaggtacttggggcatctaaagcaaagcaggatgaggctgatcaacagcacttctgccacttgaaaacacctatgaccttgcaaaagacaatgtgccaagaatgcaaggtaataatcaagacctcattacttttgaagaagcaaattagccaaatttggttctgatccaatcaaatctgataatggttgtactgaagatgacacctcctctcattctgatgacactatgaaagaatgtctttaagtttctaatgagctcgttgaaagtgaatctcataaggaaaagactgctaaacagtaggacgaggtttcaccctgttggccaggctggtctcgaactcctgacctgaagtgatgcacctgccttggcttcccaaggtgctggaattacaggcgtgagccaccgcgcccggcctagaggattcttttataggaatctacacaggagcagtggattcagtgttcactaaatctgagtttgtggtgacttacagagtataactacctgaaataacaagaatcgactttagttttcaaaataattataaacttttgtaatttataagtgctgaagttcttttatgacataaaaaagaaattgaagaagcagttcagcctcaaccaataaagaggtcattagaccattcagggtaccagtcccactgctaacaagccccactggaatcattcgggcccagcaaagcagtacagataaaggctgccataaagaatgggaaggcttttattgatgccacttcagaacagaagaaaaatgcatctacatgtccagcctctcagagccaaaggaaagaggccaaaagatacatttaacaagatggctcatcggaaaagacattcagtaacatcagaattcttatccaaagtacctgatgaagtaagacaacgctacatcaacctctttgttgagaagtatttgaaagtttgtaaaacagaggatgaggctgtttacaaggctaaaatagaaaaaaaggcaatatatgaaaggtgtagcaggagaaatatgtatgtgaacatagcagtaaattatcttaagaagctaagagatcaaggtgcttaattttatctaagtgatctactttattaagtcctcaaaacaaccatttcaggacttctcccttgggattatcttcactattagcttttctcgttttgttttattttttcacatcccctcaatggaaggcaatacacttagcaggatcaagcatgcaaaggcaagtctccacattggctcatttaccttttctctcccatctcatctggaataatcctacttcatgttttgtttcggcacctaagaagctctgttgtcgatgtggaaaaatatatggtgtgactccctcaggttgacacagcagggtagaagaatgtaactaccaatttggcggagtgttgagtcataaagtcctcagtggctttgaatctcaatacggctgttgtggaggtttccttggatcgccccggtgtcaggtcgccaagcttcatgttcatgaccacaaagaaaacctaaagggctttgtgaagacttttgtcaagttcccacctgctgatggtaatcaccgtgtgtttgcagtaagttgtgagatgttaattcacacttcagttgtggacatatcggttatgtttcctcatcagcttggcttgcctcccaaaagaccccttaggagtctaatggctgattgcctgcagagaatcgttcaggatgatggtcacaatgctagtgaaaatgcaaaagcctgcatggatctggtcatttggaaggtaaaagaagacgtgaaagg

SEQ ID NO: 12705 - DNA, 2901 bp, Homo sapiens
cttcctcacgagaataaacacacattttactctcacctgccacttcccctactatccattgttagagtccttcactcccaaatttcgccgcagactcccgcccagtctcactcaccattggttgggaaagctacgaagctccgcctttgaatagtgatgggctataaaagaccgcacctttgagggaaaaggcagcaggtcaggcgctcacctttgcctgctctctggcaacagtgctcacagtttctgagccagtggaggtggcctggagcagcagcccatgctactctctgccggttattttgccatttctctgtgcccttttgacagctccagggatcggtgccagcatttgtactgccagttcaggcacctgcagatctggtggaaaagtgagggaggtgattgcagttgcttggagatgctccaggtgcaaaggagttgtgttgagtccacagcaggagccttactggtgctggaaaagcaagtcctcctgatctacctccctactgccaaaggaacctaggatcagttcctacggactggctgtgacgggaaagaagcaccagcactcgccttagaactagcagccaagtccatctaaagtgaccaggagccttttgggtggtccctcagttcctgaaacactgggttgtagagggaagctgtcccagagatgtttggaaaggtggttggcttgggcaggcgtcaagagcatctcttccatccctcaggaggagcgggcaccagctccccagtaaccgaaagaactgctgggcctgcggggctccacggtgccccagtcctagacataactatggaaaaattagaacagaaaaaatgagttagtcaaggctgaggttgaagaagagcagaagaggatctccaaatgaactttagcacttgaagaactgactcaaagccctgtggcctccttgaatgacacaaatgtgaggcaagattttcctgaaaatagcctgctcccagaggaaaagtgaattgcaccatcaaagaacaaagacagactggaaagtatgtgatggacctcagatgtccagagactgatcttgaatatgatcctttcctcaattattctgcggaggtacttggggcatctaaagcaaagcaggatgaggctgatcaacagcacttctgccacttgaaaacacctatgaccttgcaaaagacaatgtgccaagaatgcaaggtaataatcaagacctcattacttttgaagaagcaaattagccaaatttggttctgatccaatcaaatctgataatggttgtactgaagatgacacctcctctcattctgatgacactatgaaagaatgtctttaagtttctaatgagctcgttgaaagtgaatctcataaggaaaagactgctaaacagtaggacgaggtttcaccctgttggccaggctggtctcgaactcctgacctgaagtgatgcacctgccttggcttcccaaggtgctggaattacaggcgtgagccaccgcgcccggcctagaggattcttttataggaatctacacaggagcagtggattcagtgttcactaaatctgagtttgtggtgacttacagagtataactacctgaaataacaagaatcgactttagttttcaaaataattataaacttttgtaatttataagtgctgaagttcttttatgacataaaaaagaaattgaagaagcagttcagcctcaaccaataaagaggtcattagaccattcagggtaccagtcccactgctaacaagccccactggaatcattcgggcccagcaaagcagtacagataaaggctgccataaagaatgggaaggcttttattgatgccacttcagaacagaagaaaaatgcatctacatgtccagactctcagagccaaaggaaagaggccaaaagatacatttaacaagatggctcatcggaaaagacattcagtaacatcagaattcttatccaaagtacctgatgaagtaagacaacgctacatcaacctctttgttgagaagtatttgaaagtttgtaaaacagaggatgaggctgtttacaaggctaaaatagaaaaaaaggcaatatatgaaaggtgtagcaggagaaatatgtatgtgaacatagcagtaaattatcttaagaagctaagagatcaaggtgcttaattttatctaagtgatctactttattaagtcctcaaaacaaccatttcaggacttctcccttgggattatcttcactattagcttttctcgttttgttttattttttcacatcccctcaatggaaggcaatacacttagcaggatcaagcatgcaaaggcaagtctccacattggttcatttaccttttctctcccatctcatctggaataatcctacttcatgttttgtttcggcacctaagaagctctgttgtcgatgtggaaaaatatatggtgtgactccctcaggttgacacagcagggtagaagaatgtaactaccaatttggcggagtgttgagtcataaagtcctcagtggctttgaatctcaatacggctgttgtggaggtttccttggatcgccccggtgtcaggtcgccaagcttcatgttcatgaccacaaagaaaacctaaagggctttgtgaagacttttgtcaagttcccacctgctgatggtaatcaccgtgtgtttgcagtaagttgtgagatgttaattcacacttcagttgtggacatatcggttatgtttcctcatcagcttggcttgcctcccaaaagaccccttaggagtctaatggctgattgcctgcagagaatcgttcaggatgatggtcacaatgctagtgaaaatgcaaaagcctgcatggatctggtcatttggaaggtaaaagaagacgtgaaagg

SEQ ID NO: 12706 - DNA, 3320 bp, Homo sapiens
gtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctgcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctccactcacacatgtagacaaacattagctctttactctttctcaaccccttatatgattttaataattctcacttcactaattttgtaagcctgagatcaataagaaatgttcaggagagaggaaagaaaaaatatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaa

SEQ ID NO: 12707 - DNA, 1727 bp, Homo sapiens
agccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtgcgtatgtagcaaaaccagaatccctcagctgacactgaagacgagcctggggtggagaggagggagccggcatctgccgagcacctcctgtttgccaggcgctttctatacttaatcccatgtcatgcgaccctaggactttttttaacatgtaatcactgggctgggtgcagtggctcacgcctgtaatcccaacactttgggaggctgaggcaggaggactgtttgagttcaggagttttaagaccagcctgaccaacatggtgaaaccccatctctactaaaatataaaaattagccgggtgtggtggcgagcacctgtaatgtcagctacttgggaggctgaggcaggagaatcacttgaacccaggaagcggaggttgcaatgagctgagatcacaccactgcactccagcctgggtgacagattgagactccctctcaaaaaaa

SEQ ID NO: 12708 - DNA, 2242 bp, Homo sapiens
agccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaa

SEQ ID NO: 12709 - DNA, 5343 bp, Homo sapiens
cctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcgctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctctgcacgactcgtctccaattgttaatcgaatcgcctgaacccaggaggcagaagttgcagggagccaagatcaagccactgcactccagccggggtgacagaatgagtctcaaaaacaaaatcccaaaaatgaccagtttgcattataaatatttatgactaggttttgaacaggagacaatctgtaagattcctgtctagactagaagtagaaaagctttattatacccagcgcagcatttctgctaagttgaccaggatggttacagaaaaacatcctgtaagcatttctgtctcataagtaccacatcccatatccctcatgacctatatactacagaagatgcctgtaatcccagtactttgggaggctgaagcaggattgcttgagctcaggagttcgggagcctaggcaacatggctagaccacctctacaaaaaaacttcaaaaactacccaggtttggaggtgtgcatctgtagtcccagctacttggaaggctgaggtgggaagatcacctgagcctggggaggtcaaggctgtagtcagtgtgccactgcactcccagcctgggtgagagcaagaccccgtctccaaaaaaaatcaggaccacgtgtcactaaattctgagtaccagtcaagaggctcaattgtcaccagttaggtccccgccttggcaaactgctgtaacattatacctgaagcagcagctggtgggagggttataggagactgaaagtgcttttccagttaaccgtggtggattacctggaagagcaatttgtacatcatcctgttctttttggacagaagttacaggatgcaatttaggcatcccgtaagaatctgtgtaagaaattcatctggatatttccatgcatattttctcaattctcacaagcatcacatggaataacttgtcacctaactttacaaaagcaaggctaagaatgactacttgtggcttgggagccacaagcttcttcaagtgtctcagaacctacctggtgtgagggccaagtctgtacccctcatacccagcctcaactggagatgactaaggctagtctgtgcacttgaggccacattcccctgttcaaggactgagtgtcctttacaaatcccctccaaatgggagattccaaaggggcttaagcaaaagaacaatctctgtggcaaa

SEQ ID NO: 12710 - DNA, 759 bp, Homo sapiens
ccatattccctcccgccggccggctccgcggcgcgcagccaccatgagcaccgccgccttccacatctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtgttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggcctt

SEQ ID NO: 12711 - DNA, 5343 bp, Homo sapiens
cctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggccggccacacacccggagcaccgtcatcacagcggtcaagttccttatctcggaccagccccatcccattgaccccctcctgaagagcttcatcgctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctctgcacgactcgtctccaattgttaatcgaatcgcctgaacccaggaggcagaagttgcagggagccaagatcaagccactgcactccagccggggtgacagaatgagtctcaaaaacaaaatcccaaaaatgaccagtttgcattataaatatttatgactaggttttgaacaggagacaatctgtaagattcctgtctagactagaagtagaaaagctttattatacccagcgcagcatttctgctaagttgaccaggatggttacagaaaaacatcctgtaagcatttctgtctcataagtaccacatcccatatccctcatgacctatatactacagaagatgcctgtaatcccagtactttgggaggctgaagcaggattgcttgagctcaggagttcgggagcctaggcaacatggctagaccacctctacaaaaaaacttcaaaaactacccaggtttggaggtgtgcatctgtagtcccagctacttggaaggctgaggtgggaagatcacctgagcctggggaggtcaaggctgtagtcagtgtgccactgcactcccagcctgggtgagagcaagaccccgtctccaaaaaaaatcaggaccacgtgtcactaaattctgagtaccagtcaagaggctcaattgtcaccagttaggtccccgccttggcaaactgctgtaacattatacctgaagcagcagctggtgggagggttataggagactgaaagtgcttttccagttaaccgtggtggattacctggaagagcaatttgtacatcatcctgttctttttggacagaagttacaggatgcaatttaggcatcccgtaagaatctgtgtaagaaattcatctggatatttccatgcatattttctcaattctcacaagcatcacatggaataacttgtcacctaactttacaaaagcaaggctaagaatgactacttgtggcttgggagccacaagcttcttcaagtgtctcagaacctacctggtgtgagggccaagtctgtacccctcatacccagcctcaactggagatgactaaggctagtctgtgcacttgaggccacattcccctgttcaaggactgagtgtcctttacaaatcccctccaaatgggagattccaaaggggcttaagcaaaagaacaatctctgtggcaaa

SEQ ID NO: 12712 - DNA, 759 bp, Homo sapiens; identical to SEQ ID NO: 12710

SEQ ID NO: 12713 - DNA, 1982 bp, Homo sapiens
ggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagtt

SEQ ID NO: 12714 - DNA, 2093 bp, Homo sapiens
ggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagtt

SEQ ID NO: 12715 - DNA, 2096 bp, Homo sapiens
ggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagtt

SEQ ID NO: 12716 - DNA, 3093 bp, Homo sapiens
aaacattttttggatgggacaacttgtatttgtccctttcgcttccacgtccaaacccctttaagaaggatgaatgggcaggatgagttagactccttcgctgtatcgtctactgattcttaaaatgtgacaaatctgattggacgacttacatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaaggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaaaaaaaaaaaaaaaaaaaa

SEQ ID NO: 12717 - DNA, 3093 bp, Homo sapiens
gcggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgatatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaaggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaaaaaaaaaaaaaaaaaaaa

SEQ ID NO: 12718 - DNA, 3138 bp, Homo sapiens
ctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgagatggtgccttgctgtgttgcccaggctggtctaaaactcctgggatcaagtgatcctcccaccttggcctcccaaagtattgtgattacagggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgagaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccaggaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccccccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcagcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagaggcaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcctgccgagaggggcagttttgctcttttgtacattttccgaaactacagttaaagcggaagtctgttttcaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgattcttggaaaaaaaagtttcttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 12719 - DNA, 2836 bp, Homo sapiens
ctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttctttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacctgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgtccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaaa

SEQ ID NO: 12720 - DNA, 4513 bp, Homo sapiens
ccacgcgtccgcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccagtggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaaaaaaaaaaaa

SEQ ID NO: 12721 - DNA, 654 bp, Homo sapiens
atgagctggacctgtccgcgttgccagcaacctgttttcttcgctgagaaggtgagctccctgggcaagaactggcaccgcttctgcctgaaatgtgagcgctgccacagcatcctgtcccctggcgggcatgcagagcacaatgggaggccatactgccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaagccctccccatatgaagacattcactggggagacctcgctgtgccctggctgtggggagcccgtctattttgctgagaaagtgatgtcattaagcagaaattggcaccgaccgcgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaa

SEQ ID NO: 12722 - DNA, 629 bp, Homo sapiens
acagcaaccagaaaacatctgctcacttccttcaaaatgggaaagatcaccttctacgaggacagggccttccagggccgcagctacgaatgcaccactgactgccccaacctacaaccctatttcagccgctgcaactccatcagggtggagagcggctgctggatgatctatgagcgccccaactaccagggccaccagtacttcctgcggcgtggggagtaccccgactaccagcaatggatgggcctcagcgactccatccgctcctgctgcctcatccccccgcactctggcgcttacagaatgaagatctacgacagagatgaattgaggggacaaatgtcagagctcacagacgactgtctctctgttcaggaccgcttccacctcactgaaattcactccctcaatgtgctggagggcagctggatcctctatgagatgcccaactacagggggaggcagtatctgctgaggccgggggagtacaggaggtttcttgattggggggctccaaatgccaaagttggctctcttagacgagtcatggatttgtactgaagtatttacgttttccacttttctcctttaaaatctaataaaatatttagcttgtgtttctggca

SEQ ID NO: 12723 - DNA, 674 bp, Homo sapiens
ccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttaaaaaaaaaaaaaaaaa

SEQ ID NO: 12724 - DNA, 3877 bp, Homo sapiens
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcagccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcaatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgaa

SEQ ID NO: 12725 - DNA, 3005 bp, Homo sapiens
cagtggtggaagaagaggcggcggcggcgggggtagggagcctggaaacgcgagcggggatggtaggtggtttggacccgccgggccgccgtcgtttccagaaagggtttgactggaggaacctctggagcagctgttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggcggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattaccgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaataaaaaaaaaaaaaaaaaaaaaaaaaaaaaaaaaaaaaaaa

SEQ ID NO: 12726 - DNA, 6594 bp, Homo sapiens
cggtgcggttccgccgggcgcgaggagccgccgagacctccgcctgcgaacaaagaggaggccgtgcggggcgcggcgcccgcggagcatggcggaccgcagcctggagggcatggcgctgcccctggaggtgcgggcgcgcctggccgagctggagctggagctgtcggaaggtgacatcacacaaaaaggatatgaaaagaagaggtcaaagttaattggagcctaccttccgcagcctccgagggtggaccaagctttgccgcaagaacgccgggctcctgtcactccttcctccgcctctcgctaccaccgccgacggtcttcagggtcacgagatgagcgctatcggtcagacgtccacacggaagctgtccaggcggctctggccaaacacaaagagcggaagatggcagtgcctatgccttccaaacgcaggtccctggtcgtgcagacctcgatggacgcctacacccctccagatacctcttctggctcagaagatgaaggctcagtgcagggggactcccagggcacccccacctccagccagggcagcatcaatatggagcactggatcagccaggccatccacggctccaccacgtccaccacctcctcgtcctctacgcagagcgggggcagcggggctgcccacaggctggcggacgtcatggctcagacccacatagaaaatcattctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggatacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagcagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgtt

SEQ ID NO: 12727 - DNA, 5337 bp, Homo sapiens
gatgcccccgccaggggggatgcccggcaccgtgcgtccgcggaggccaagatgcagcggccaggggccggcagcctgcgaggggaggcagcttccgccggggccgggctgctgcacagtctgagcggccgggactgcgcgcttcagagcctggagcatcccagtcgctggggccgagacgccgccgccgccgccgttcccgctttctcccgcgagccgggccagtagctttgctagctggccttcccgtggaggcgttttccagccccagcgcggggagacatgcctgaatttgggagcgatgtgactctcagcctcccacttcacccggggacgcaggcttgctgaagcccgagacaggagggggaccatgggagggacgcaagtcaaatgcctgacttcacccagtccaatccacagtgcaaagagcgagtccattataacccagtcagaagagaaggcagattttgtgattattcccgctgaaggaatagagaacagaacagaagggacagattctccattatctcgagactggcggccagggagccctggaacctatctggagacctcatgggaagaacagctgttggaacaacaagaatatttagaaaaagaaatggaggaagcaaagaaaatgatatcaggactacaggccttactgctcaatggatccttacctgaagatgaacaggagaggcccttggccctctgtgaaccaggtgtcaatcccgaggaacaactgattataatccaaagtcgtctggatcagagtatggaggagaatcaggacttaaagaaggaactgctgaaatgtaaacaagaagccagaaacttacaggggataaaggatgccttgcagcagagattgactcagcaggacacatctgttcttcagctcaaacaagagctactgagggcaaatatggacaaagatgagctgcacaaccagaatgtggatctgcagaggaagctagatgagaggaaccggctcttgggagaatataaaaaagagctggggcagaaggatcgccttcttcagcagcaccaggccaagttagaagaagcactccggaaactctctgatgtcagttaccaccaggtggatctagagcgagagctagaacacaaagatgtcctcttggctcactgtatgaaaagagaggcagatgaggcgaccaactacaacagtcacaactctcaaagcaatggttttctccttccaacggcaggaaaaggagctacttcagtcagcaacagagggaccagcgacctgcagcttgttcgagatgctctccgcagcctgcgcaacagcttcagtggccacgatcctcagcaccacactattgacagcttggagcagggcatttctagcctcatggagcgcctgcatgttatggagacgcagaagaaacaagaaagaaaggttcgggtcaagtcacccagaactcaagtaggtagtgaataccgggagtcctggccccctaactcaaagttgcctcactcacagagctctccaactgtcagcagcacctgtactaaagtgctctatttcactgaccggtcacttacgcccttcatggtcaatataccaaagaggttggaggaggtgacgttaaaggattttaaagcagctattgatcgggaaggaaatcaccggtatcacttcaaagcactggatcctgagtttggcactgtcaaagaggagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatggtgctgaattgttgcttggatggaaaaagggctgcccatgttgtgctacactatgctaaaactgtaatttagtaagaccttgggctgcctcttctgtcttaactggttctgcagcttgtccttttgcccacatagggcctatttcatgtactgttagttttctctggggactctttaactttagagccatttctttttcttcaaactgatgaacttttgtttgaaaggcataaggagtgaaaagctccttgaaaatccaggcgggtatggaaaggtgctgctacccatatctttttgactttctttgtttcatgactttaactcatggcatctcctttgtagtaaaaggagacagaccattaatttcagcatttctttgtgatttataagtactgagcatgaagtacttgtctgcccctcatttcaaggccagagttattttctatttatgtattagtctaggctgatcttttagggcacaatagaaaccatggggcgtggagcatgagttgtgaatggcagggatcattctgggtaaaaaaaacctagaatcatttctgatgtgcaacattgtcaagtgaagaagctaacagttcaactaccgagattatttgataacctgggttttctcattcatccatcaagcaccatcaaccagtcagccattattatttatatatgtattaccaaaagcagtctatctgcctgtgacctccaatgtacactgccaaacacaagagtaggacacatctgttctgggttcttgacctatctgtctccaattcatctccccttttcagccatttcaacaaactactctttggagctctgagatgacatcttgttgttttatatagatgtatcttttaaaaatagttcacgtttggagaattcttttgtactcatttgctttttgtctgagaaccatgtctatttttataactggagtgtgagttctgtatcttctcacattctgtatactgtatccattttctagagaacccagtagcttttatacagtctcttcttaccaccccttgtggtttcagaacaagctttattttattacgagtatattaatgacaactaattcctgttccaattctacctgttttagttgtgaaggtagttttgtgtaatccagttgattgctcctctggcagagagaaggagctcaaaagatacttgatgtctttcatgtaagtttacctggtcttttcctattgaagaatttttcatcagaaacgactgggaaagtttgggaaagtcagcaaaagaaagaatgcatttcgaaagcaaacagaagaaaaaagtatattctcacagtttttccccaggaagtctggagaaaaagtcctcatgtcaccaatttctctgttgcatgaattttagtgttttgctataagacagcatgagggctatcaggccaaaattcattattgtatttccaatacagtttgtcttgaatgtctgtctcttaaaccagtttttacttgtcagttttctctcagcaaacagtcttactattatgtggaatttaacttttcagagaaaatttccaaagtcctctaccttatttggcttttatctgtgtcttttggaaaaggagctgcatggcctcagtgcctccataaaaagcttaagttgagttcatgggagaacattaagatcgttttttttcccttttagctcggtaatctcatgtaccacaggtaatgaccaagcatctctgctagaggatgtaactctcataactcctgtgtaaaatgaggatcctgttggtgatcctcattccagtttccaaagcgagaggagccttctgagcagaagtatgcaagactgattctgtttggaacagtttcctatttggctgcattctaggaggcctcctgacttattcatagtattgtcgcctggtggcattggtgtggggtagcttgtcctgctacttgctaaagttctctttctttgagaaaactgaggaaccagaatgcttagagttcataaaataatctctaaaccatgttaggttaaaacaaaatgaccatctcacaaaaacgagtttagttgaatgctcaattccttacaaaatcttcatttaaggctgagtgtggtggctcatgcctgtaattccagcactttgggaggccgaggcaggaagactgcttgagcccaggagttcaagaccagcctgggcaacgtaggaagactccgtctctacatagaaattttattataaaagtagctggggatggtggcacacacctgtagtcccagctactcaggaggttgaggtgggaagattgcttgagcccaggagtttgaggttgcagtgagctgatcatgccactgcactctagcctaggctacagagcaggaccccatctccaaaaaaaaaaaaaaaaaagtcatttaaaaactgaagaatgttctcttcttgctcagttccctaaattagctggggggattgggatactttacaatttttacatttttaaatttgaagaatttgttttaaacttacttggtaatggcacttctacttactgaccaacttttcagctctttttgaccaggatggttgcaaattagggaaaatatctttatactatacatccaattcaagaggactttaattacttaaaagcatttaggtcataattaaaattattttcactgtttccataaaataagcattatgattgcacactccttctactgtctgaatttatgtaagaggtatagcttgcttaaaatacatatatatgtaaagttatattttcttagaaacatggatgtttacagccattgctttcaaagagattattactgtgtattctccctgttttacaatatgttttcatgaagactatgttacaccagaggcttctgattatcaaagtgataaccagttttaactgccggtatgtaccagatttgtgaactaatttaaaaaaccacaaactatgaataaaatggggtttgcaaactaaa

SEQ ID NO: 12728 - DNA, 1829 bp, Homo sapiens
cccggtagtcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctgggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttctcaaaaaaaaaaaaaaaa

SEQ ID NO: 12729 - DNA, 2513 bp, Homo sapiens
cccggtagtcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagttgccttgcagttccctgaccagctattgggagatgctgtggctgtggctgcacgactggaggagacgacagggtcaaagatgttcattctgggtgacacagcctacggcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctggaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttctcaaaaaaaaaaaaaaaa

SEQ ID NO: 12730 - DNA, 3222 bp, Homo sapiens
gagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtttttaaaagccggggcgcgagaaacaggaaggtactatggcttcctcgtctggcaacgatgatgatctcactatccccagagctgctatcaataaaatgatcaaagagactcttcctaatgtccgggtggccaacgatgctcgagagctggtggtgaactgctgcactgaattcattcaccttatatcttctgaagccaatgagatttgtaacaaatcggaaaagaagaccatctcaccagagcatgtcatacaagcactagaaagtttgggatttggctcttacatcagtgaagtaaaagaagtcttgcaagagtgtaaaacagtagcattaaaaagaagaaaggccagttctcgtttggaaaaccttggcattcctgaagaagagttattgagacagcaacaagaattatttgcaaaagctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaagactgcccagtttggaagtctgtcatgatttttactctttcactccaattcagtaattgttgatagtattacttacctagtccatccatactcatattattcaaatatataggtggtacttttgaaacaattacattggttctcttggtttaactgaggtttatgaatattcaaacctttgctgggggaaagaaatgaaagttaatgagcatgcttgctatgagagagggatttttaatttaacttgtagttatagtttacttattgtttttagaattacttttacattttcccaactagatggcctagagtccaacattaccttttgagatgacattattgtctccataattgagtgatagctttaaaaaaaagattagttttgcttaagaagttatgttacaactgatcagccctatatgaattaactgatcagccctatatgaaacataagttgtgttataacttatcagccgtatatggaacataaatagtttctacctgcttgttagagaagctttaatttggttctaataaatacagtatggtagtgtttataggaatccaggatgttgaagaaatggcataatgtctatattttggaaacagaaaggaaaagtcacttaagatagtattaagtaattaaattcctatgtcagttgccaaatcttttaaacttatgtattcaccaagcccaaaaatagattgtggctcccaggattccaattttaattggagagctaagtaagtaaagttttataactgttaggtttcttaatgatcatattttgcagttttagtaaaagggaaatattgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaaaaaaaaaaaaaaa

SEQ ID NO: 12731 - DNA, 3894 bp, Homo sapiens
ctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaataaagacattttaaatttaatcactgtttttattataagttccttagttcagatatcctttattaatttataagatgtgtaaaactacttaattctcacaagactctatgaagtaattcttttaatctctattttataaatgaaaaaactaaggccataaatttaagaaatttgtcagtgtctcaaagctaggaaatggccatctaatcccagagcctatgctttaggtcactatgatatatactactcctgtatcctcaagtaatgtatcatttagtaacactaagcaccctgcttagttttcatggatactgccaaattgccctatctcaagctttatacttgcaccatttaaagttttccacactgttggcaatatcagaagtgataaggctttgaaatgttcgccactttgataaagaggaaatgattgtttgttactgttatatacatgtatttttatcagagatgggttatgtacttttccacgtttgatagttggttgtatttctttagtgaattgatttttcttttcctttgcccatttttctgtttggatgtttgactttcttcttaatttgtaagagtatcctatgtagtaacaaaatccttttttaaaaatttttaaagaaaaagtatacacacaggacttttttttttctaattcaaaaaatacaaaggcatgcaatgaaaattaagtctgttccactaccacattttccagttttttgtgtatctttctaatgatagataccatatgagtattcaaatatacatacacatacacttaaaaaaaaaagatggcatatactaactgttctgtttggggctttttggtggtggtgtttgtttgacagggtctcactctgcctcccaggttggagtgcaccttgaactcctggactcaagtgatccttcacctcctccttccaagtatctgacactacaggcttgcatcactatgcccagcttatactcaccatagtggttctgtactcccttaaaatattctggaggccaggcatgctggctcacacctgtaatcccagcaccttgggaggccaaggtgggtggatcacctgaggtcaggagttcaagaccagcctgatcaacatggtgaaaccccatctctactaaaaatacaaaagtatccaggcgtggtagcacatacctgtaatcccagctacttgggaggctgaggtaggaaaattgtttgaacccggcagacagaggttgcagtgagccgacatcgtgccattgcactccaagcctgggcaacaagagtgaaaccgtctcacacacacacaaaaaaaaatattttggagctccttctatatgagtctctctctcttatctctctcaggatgtgtgtatgtgtttgtttctctggaaaaccctgactaatacagattagctatgtattaggtaatacataatgcctaatacataactaatatatggacaggaagttaatagactgactgtgccaccttaaaactcgtatgttgaagccctaacctccaacgtggtggtattgggagatgggccttttggaaggtaagtgtgtttgaatgaggtgaagaggttggggacttcgtgatgggattattgtccttacaagaaaagacaccagagagcttgttctgtctctttgggccatgtgaagacatggtgagaaagcagccagctgtaagccagagagtcctcaccagaacctaaccatgctggtgatatcctcatctcagacttctaacctccagaactgtgagaaaataaacttctttgtttaaaccaaaaaaaaaaaaaaaa

SEQ ID NO: 12732 - DNA, 4536 bp, Homo sapiens
gaattccacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaaaaaaaaaaaaaa

SEQ ID NO: 12733 - DNA, 1524 bp, Homo sapiens
agcagtcctgtcatgcggaagtagcagtccggtcctagggactagcaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctttttgaacttgaaaaaaaaaaaaaaaaaaa

SEQ ID NO: 12734 - DNA, 4575 bp, Homo sapiens
gtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggaggtgtagtccccgatctgcgtactgcgttcgccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgtgttctgtgccaaggtctttgtggctaggctgcgccaacctggtagagagcatgtgcgcactgagttgcctgcagagcatgcccagtgtcagatgtctccagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 12735 - DNA, 4536 bp, Homo sapiens
gtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggaggtgtagtccccgatctgcgtactgcgttcgccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgaacacttcagttatggaagatcaaaatgaagatgagtccccaaagaaaaatactctttggcagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 12736 - DNA, 4473 bp, Homo sapiens
gtagtcgtggcgctctcgaggccctgccatgagcaagctcttaactcttcaggtctgcacgtcctacgcccaccgtccagtgctactctcagctcggagttcagcttcgggctgccaagagccagcaacctggtgtcagaggctcggtcccacaacgctctgcgggccgcggcgcctgctgggaggtgtagtccccgatctgcgtactgcgttcgccgagggggagggcggagctgccggcggcccgggcgggctggcagctagagtgggtgcgatagccgcctccgcctctgccgcctccgccgtcgcctcctccgcccgggccgttcgctgctgcgcggggagagcgaggcggggccgccggggccgccatggagcccgactcggtgattgaggacaagaccatcgagctcatgataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtgggatcagtacctgtttaaaaacagacccacagatggccctccaaattcattttataggtcattatacccaaagattatccaggatatagagactatagaatctaactggcggtgtggacgacacaacttgcagaggattcagtgccgctctgaaaatagtaaaggtgtctactgtttacagtacgatgatgaaaaaattatcagtggcctacgagataattctattaagatatgggataaaaccagcctggaatgtttgaaagtgttaacaggacacacaggctctgtcctctgtctgcagtatgatgagcgtgtcattgtaactggctcttcagattctacggtgagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtctggagcacgagcacctgtgaatttgttcgtactctcaatgggcacaagcggggcattgcctgtctccagtacagggatcgcctggttgttagtggatcatcagataataccattaggctctgggatattgaatgtggtgcctgtttaagagtcctagagggacatgaagaattggtccgatgcatccggtttgataacaagaggattgtcagtggggcctatgatgggaaaattaaagtttgggacttgcaagctgctcttgaccctcgagccccagcaagcacattgtgtttgcgcacattggtggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcagggttttctagtcttgaactactggctacgtggctaccaaatgcctaagggagttcgttcacagctgagttatgaagctggaattggttctagacgctgggtagatgcaaagcagcctaactcttcaagtaccgacatttctcacctctgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactc

SEQ ID NO: 12737 - DNA, 2589 bp, Homo sapiens
cggaagtagtgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgagcttatatagaattggtgataggatcacaacttctgaggtcccagcaagagtcctaacatctagcagctctaccaccaggacaggccccctaaaactaattccaacaagcacctctgaagtcttctcattcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggccggctgactaaaacagttaaggaaacaactcgtactgaacccatcaacaccacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaagtgctgggattgaacccttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatataccctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatggtggctcatgcctgtaatcccagcagtttgggaggctgagggcaggtggatcacttgagatcgggagttcgtgaccagcctggccggcatggtgaaagcccgtctctactgaaaatgtaaaaattagccgggcgtggtggcatgtgcctgtagtcgcagctacttgggaggctaagacaggagaattgcttgaacctgggaggtggaggttgcagtgagctgagatcgcgccactgcactccagcctgggcaacagtgagacaccgtctc

SEQ ID NO: 12738 - DNA, 2205 bp, Homo sapiens
ccgggacgcagggcaaagcgagccatggctgtctacgtcgggatgctgcgcctggggaggctgtgcgccgggagctcgggggtgctgggggcccgggccgccctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtggtccagtgcctggagaccacagcacagagggtcccagaacgagaggccttggtcgtcctccatgaagacgtcaggttgacctttgcccaactcaaggaggaggtggacaaagctgcttctggcctcctgagcattggcctctgcaaaggtgaccggctgggcatgtggggacctaactcctatgcatgggtgctcatgcagttggccaccgcccaggcgggcatcattctggtgtctgtgaacccagcctaccaggctatggaactggagtatgtcctcaagaaggtgggctgcaaggcccttgtgttccccaagcaattcaagacccagcaatactacaacgtcctgaagcagatctgtccagaagtggagaatgcccagccaggggccttgaagagtcagaggctcccagatctgaccacagtcatctcggtggatgcccctttgccggggaccctgctcctggatgaagtggtggcggctggcagcacacggcagcatctggaccagctccaatacaaccagcagttcctgtcctgccatgaccccatcaacatccagttcacctcggggacaacaggcagccccaagggggccaccctctcccactacaacattgtcaacaactccaacattttaggagagcgcctgaaactgcatgagaagacaccagagcagttgcggatgatcctgcccaaccccctgtaccattgcctgggttccgtggcaggcacaatgatgtgtctgatgtacggtgccaccctcatcctggcctctcccatcttcaatggcaagaaggcactggaggccatcagcagagagagaggcaccttcctgtatggtacccccacgatgttcgtggacattctgaaccagccagacttctccagttatgacatctcgaccatgtgtggaggtgtcattgctgggtcccctgcacctccagagttgatccgagccatcatcaacaagataaatatgaaggacctggtggttgcttatggaaccacagagaacagtcccgtgacattcgcgcacttccctgaggacactgtggagcagaaggcagaaagcgtgggcagaattatgcctcacacggaggcgcggatcatgaacatggaggcagggacgctggcaaagctgaacacgcccggggagctgtgcatccgagggtactgcgtcatgctgggctactggggtgagcctcagaagacagaggaagcagtggatcaggacaagtggtattggacaggagatgtcgccacaatgaatgagcagggcttctgcaagatcgtgggccgctctaaggatatgatcatccggggtggtgagaacatctaccccgcagagctcgaggacttctttcacacacacccgaaggtgcaggaagtgcaggtggtgggagtgaaggacgatcggatgggggaagagatttgtgcctgcattcggctgaaggacggggaggagaccacggtggaggagataaaagctttctgcaaagggaagatctctcacttcaagattccgaagtacatcgtgtttgtcacaaactaccccctcaccatttcaggaaagatccagaaattcaaacttcgagagcagatggaacgacatctaaatctgtgaataaagcagcaggcctgtcctggccggttggcttgactctctcctgtcagaatccaacctggctttatgcacctagatgtccccagcacccagttctgagccaggcacatcaaatgtcaaggaattgactgaacgaactaagagctcctggatgggtccgggaactcgcctgggcacaaggtgccaaaaggcaggcagcctgcccaggccctccctcctgtccatcccccacattcccctgtctgtccttgtgattggcataaagagcttctgttttctttggcaaaaaaaaaaaaaaaaaaaaaaaaaaaaaaaaaaaaaaaaaaaaaaaaa

SEQ ID NO: 12739 - DNA, 3362 bp, Homo sapiens
agactccctgtctttgcggtttgggagatgatgagaaaccacagaattgctagtagtttatgtggagatcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcgaagattgaagcacgctcatactttgtatgtgctttagggaaggggtgggtgggcacttgggccttgcgggtgcattcatgtaatctgagactcttgaactttatgacggagtcttcaatattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagat

SEQ ID NO: 12740 - DNA, 5382 bp, Homo sapiens
gcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaaggccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttac

SEQ ID NO: 12741 - DNA, 1335 bp, Homo sapiens
gacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcgctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcgtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactgg

SEQ ID NO: 12742 - DNA, 2263 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtaccgggctagtttccccatcatcacggtgaccgccgcccacagcggaacctaccgatgctacagcttctccagcagggacccatacctgtggtcggcccccagcgaccccctggagcttgtggtcacaggaacctctgtgacccccagccggttaccaacagaaccaccttcctcggtagcagaattctcagaagccaccgctgaactgaccgtctcattcacaaacaaagtcttcacaactgagacttctaggagtatcaccaccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctcccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcctgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcggggggctgaggtgggagaatggcttgagcctgggaggcagaggttgcagtgagctgagatcacaccactgcactctagctcgggtgacgaagcctgaccttgtctcaaaaaatacagggatgaatatgtcaattaccctgatttgatcatagcacgttgtatacatgtactgcaatattgctgtccaccccataaatatgtacaattatgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagtaaaaattgttttaaaa

SEQ ID NO: 12743 - DNA, 5562 bp, Homo sapiens
cagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtcgtggagggcccccaagacccaacagagggatgccgcaaatgaacactcagcaagtgaattaatctgattcacaggattatgtttaatcgccaaaaacacactggccagtgtaccataatatgttaccagaagagttattatctatttgttctccctttcaggaaacttattgtaaagggactgttttcatcccataaagacaggactacaattgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctaggaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggataggctgttgaacattccacattcaaaagttttgtagggtggtgggaaatgggggatcttcaatgtttattttaaaataaaataaaataagttcttgacttttctcatgtgtggttgtggtacatcatattggaagggttaacctgttactttggcaaatgagtatttttttgctagcacctccccttgcgtgctttaaatgacatctgcctgggatgtaccacaaccatatgttacctgtatcttaggggaatggataaaatatttgtggtttactgggtaatccctagatgatgtatgcttgcagtcctatataaaactaaatttgctatctgtgtagaaaataatttcatgacatttacaatcaggactgaagtaagttcttcacacagtgacctctgaatcagtttcagagaagggatgggggagaaaatgccttctaggttttgaacttctatgcattagtgcagatgttgtgaatgtgtaaaggtgttcatagtttgactgtttctatgtatgttttttcaaagaattgttcctttttttgaactataatttttctttttttggttattttaccatcacagtttaaatgtatatcttttatgtctctactcagaccatatttttaaaggggtgcctcattatggggcagagaacttttcaataagtctcattaagatctgaatcttggttctaagcattctgtataatatgtgattgcttgtcctagctgcagaaggccttttgtttggtcaaatgcatattttagcagagtttcaaggaaatgattgtcacacatgtcactgtagcctcttggtgtagcaagctcacatacaaaatacttttgtatatgcataatataaatcatctcatgtggatatgaaacttcttttttaaaacttaaaaaggtagaatgttattgattaccttgattagggcagttttatttccagatcctaataattcctaaaaaatatggaaaagttttttttcaatcattgtaccttgatattaaaacaaatatcctttaagtatttctaatcagttagcttctacagttcttttgtctccttttatatgcagctcttacgtgggagacttttccacttaaaggagacatagaatgtgtgcttattctcagaaggttcattaactgaggtgatgagttaacaactagttgagcagtcagcttcctaagtgttttaggacatttgttcattatattttccgtcatataactagaggaagtggaatgcagataagtgccgaattcaaacccttcattttatgtttaagctcctgaatctgcattccacttgggttgtttttaagcattctaaattttagttgattataagttagatttcacagaatcagtattgcccttgatcttgtcctttttatggagttaacggggaggaagacccctcaggaaaacgaaagtaaattgttaaggctcatcttcatacctttttccattttgaatcctacaaaaatactgcaaaagactagtgaatgtttaaaattacactagattaaataatatgaaagtc

SEQ ID NO: 12744 - DNA, 3553 bp, Homo sapiens
cagagggctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttccagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacatttttggaatgagattgaacatttatataaatttattattcctctttcatttttttgaaacatgcctattatattttagggccagacaccctttaatggccggataagccatagttaacatttagagaaccatttagaagtgatagaactaatggaatttgcaatgccttttggacctctattagtgatataaatatcaagttatttctgacttttaaacaaaactcccaaattcctaacttattgagctatacttaaaaaaaattacaggtttagagagttttttgtttttcttttactgttggaaaactacttcccattttggcaggaagttaacctatttaacaattagagctagcatttcatgtagtctgaaattctaaatggttctctgatttgagggaggttaaacatcaaacaggtttcctctattggccataacatgtataaaatgtgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttaacagtttaggtaataaggtctgttttcattctggtgcttttattaattttgatagtatgatgttacttactactgaaatgtaagctagagtgtacactagaatgtaagctccatgagagcaggtaccttgtctgtcttctctgctgtatctattcccaacgcttgatgatggtgcctggcacatagtaggcactcaataaatatttgttgaatgaatgaa

SEQ ID NO: 12745 - DNA, 2451 bp, Homo sapiens
ctcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgttgttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggtcagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtaaaaaaaaaaaaaaaaaaa

SEQ ID NO: 12746 - DNA, 2195 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaa

SEQ ID NO: 12747 - DNA, 2123 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaa

SEQ ID NO: 12748 - DNA, 2198 bp, Homo sapiens
ccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcgtccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctgaaaaaaaaaaaaaaaaaaaaaa

SEQ ID NO: 12749 - DNA, 2150 bp, Homo sapiens
ctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaaaaaaaaaaaaaaa

SEQ ID NO: 12750 - DNA, 3224 bp, Homo sapiens
cgaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagcattggaacacgggaggtagtcacccagaaaaacttgagcggcctggtgcccatccgagacttaaggctagaccccagcctcctctgttccatccctttattagctctgagccccaatttactgattgtgtggctctttctgagcatagcatacctggtgaccaaattgcgttgcaaatgaatatcattatgaaaaattaataagtcacaagaaaaacaaaagtgccagaagatgtccagccaccg

SEQ ID NO: 12751 - DNA, 3217 bp, Homo sapiens
cgaggaccagcacctgaggccgggccgcaggccgacttcacagccaggcgcgcgcgtcgctgctgctgctgcggggctctggcgcgccagccggcgggacagcgggggctggcgggggccggggagcgccagatgatggatttggacatgcttctatgaagaaatgccacatggtccgagagcaaacatgtccaggctactcactttagtgactagggctcggtgccagcacttcccgggtaatcagacgtggtctgaccgaggatcaagaagcacatcatcaccaatgacatcatgacagcaagagagcacagccctcgccatggtgccagggcccgtgcaatgcagcgggcttccaccatcgacgtggcggccgacatgctgggcctctctctggcaggaaatatacaagacccagatgagcccattttagaatttagcttagcttgcagtgagctgcatactccatcgctagatcgaaagccaaatagttttgttgcggtgagtgtcaccacccctcctcaggcattctggacgaagcatgcacagacggagatcattgagggaaccaacaatcctatatttctaagcagtattgccttctttcaagactctcttatcaatcagatgacacaagtcaaactctccgtgtatgatgtcaaagatagatctcagggaacaatgtatttactgggctctggaacgttcattgtcaaagatctgctccaggacaggcatcataggttgcatttaacactaaggtctgcagagagtgaccgtgtaggtaacatcaccgtgattggctggcagatggaggagaagtcagaccaacggccccctgtgacccggtctgtggacactgtcaatgggaggatggttcttcctgtcgatgagagcttgacggaggcgttaggaatccgatccaaatacgcttcattgcgaaaggacactttgctgaaatcggtgttcggtggtgccatctgccgcatgtaccggtttccaaccactgatggtaaccatttgcggatcctggagcagatggcagagagcgtgctctccctgcacgtgccccggcagttcgtgaagctcctactagaggaagatgcagccagagtgtgtgagctggaggagctgggagagctgtccccttgctgggagagcctccggcgccaaattgtcacccagtaccagaccatcatcctcacataccaggagaacctgaccgacctccatcagtacagagggccctcgtttaaagcaagcagtttgaaagcagataaaaagttagaatttgttcccacaaacttgcacatacaaaggatgagagttcaagacgatggaggatcagatcagaactacgacatcgtcaccattggggcgccagcagcacactgccaaggttttaagtcaggaggtctccgcaaaaagctgcacaaatttgaagagaccaagaaacattttgaggagtgttgtacatcatctggctgccagtccataatctacataccccaggatgttgtcagagccaaggagatcatcgcccagatcaacaccctgaaaacccaagtgagttactacgcagagcggctgtcaagggcagccaaggacaggtctgccactggccttgagaggacactcgccatcttggcagacaagacacggcagctggtcacggtctgcgactgcaagctcctggccaactccatccatgggctgaacgctgcacggcctgactacattgcctccaaggcctctcccacttcgactgaggaggagcaggtgatgcttagaaatgaccaggacaccctcatggcccggtggacagggagaaacagccgatcttccctgcaggtggactggcacgaggaggagtgggagaaagtgtggctgaacgtggacaagagcctagagtgcatcattcagcgtgtggacaagctgctgcagaaggagcggctgcatggcgagggctgtgaggatgtcttcccctgtgcaggcagctgcaccagcaagaaagattgcagtccccctcctgaagagtccagcccaggtgaatggagtgaggccctttacccgctgctgaccactctcaccgactgcgtggccatgatgagtgacaaggccaagaaggccatggtattcctgctcatgcaggacagcgcgcccaccatagccacctacctgagcctgcagtaccgccgtgacgtggtcttctgccagacgctgaccgccctcatctgcggcttcatcattaagctgaggaactgcctgcatgacgacggcttcctgcgccagctctacaccatcgggctgctggcccagttcgagagcctgctgagcacctacggggaggagctggcaatgctggaggacatgagccttgggatcatggacttgaggaacgtgaccttcaaagtcactcaggccacttccagcgcctccgcagacatgctgcccgtcatcacaggaaatcgcgacgggtttaacgtgcgggtccctctgccgggcccgctgtttgacgccttgccccgggagatccagagtggcatgctgctgcgagtgcagcccgtcctcttcaacgtgggcatcaatgagcagcagacactggccgagaggtttggcgatacgtctttacaagaagtcatcaacgtggagagtttggtgcggttaaattcctactttgagcagtttaaggaagttttgcctgaggattgcctgcctcggtctcgcagtcagacgtgcctgccagagctgctgcggtttctgggtcagaacgtgcatgcccggaagaataagaacgtcgacattctctggcaagctgctgagatctgccgccgccttaatggggtccggttcaccagctgcaagagcgctaaggaccgtacagccatgtcggtgacactggagcagtgcctgatcctgcaacacgagcatggcatggccccgcaggtcttcacccaggccctggagtgcatgcgcagtgagggttgtcgaagagaaaatacaatgaagaatgttggaagtcgcaaatatgcatttaattccctgcagctgaaggctttccccaagcattacaggcctcccgaagggacttacggaaaagttgaaacgtgaacacacggtttcctctaattagctgttacataataaatgtgggtacctctagtgtcatatatgaattcttcaggagactgaaggattggtttattttgtgttcttt

SEQ ID NO: 12752 - DNA, 5361 bp, Homo sapiens
ctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggccttgatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcctattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaaaagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggatggactttgcatttctgatctagtcctagatgtccgacaaataccagctgctcaagaacaaccctttattgtcagcaaccaaaacaaaaggttaacattttcagtaacactgaaaaataaaagggaaagtgcatacaacactggaattgttgttgatttttcagaaaacttgttttttgcatcattctccctaccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgcatggatttctttttaaatcccatattttttttatcatgtcgtaggtaaactaacctggtattttaagagaaaactgcaggtcagtttggatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttataccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatttatgtaaaatcccatctgctagaagcccatcctgtgccagaggaaggaaaaggaggaaatttcctttctcttttaggaggcacaacagttctcttctaggatttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctagagtgaatttctaaatgttggaatgttatgggatgtaaacaatgtaaagtaaaacactctcaggatttcaccagaagttacagatgaggcactggaaaccaccaccaaattagcaggtgcaccttctgtggctgtcttgtttctgaagtactttttcttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagattaaaattcacagacactacatatctaaagctttgacaagtccttgacctctataaacttcagagtcctcattataaaatgggaagactgagctggagttcagcagtgatgctttttagttttaaaagtctatgatctgatctggacttcctataatacaaatacacaatcctccaagaatttgacttggaaaag

SEQ ID NO: 12753 - DNA, 3262 bp, Homo sapiens
gcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtcttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctaaaaaaaaaaaaaaaaa

SEQ ID NO: 12754 - DNA, 3023 bp, Homo sapiens
ttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtattcaagaaattaagcatacggtcacgagagtgcaaagttctgtgaaacgctccagtggttacacgccccggggtttcagcttcgaccctggcttcctcatcgtcctggtctgcctcatcttcagcgtgctgtccaccatcgagcagtatgccgccctggccacggggactctcttctggatggagatcgtgctggtggtgttcttccggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctaaaaaaaaaaaaaaaaa

SEQ ID NO: 12755 - DNA, 3029 bp, Homo sapiens
gcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggacttcctcatcgtcctggtctgcctcatcttcagcgtgctgtccaccatcgagcagtatgccgccctggccacggggactctcttctggatggagatcgtgctggtggtgttcttcgggacggagtacgtggtccgcctctggtccgccggctgccgcagcaagtacgtgggcctctgggggcggctgcgctttgcccggaagcccatttccatcatcgacctcatcgtggtcgtggcctccatggtggtcctctgcgtgggctccaaggggcaggtgtttgccacgtcggccatcaggggcatccgcttcctgcagatcctgaggatgctacacgtcgaccgccagggaggcacctggaggctcctgggctccgtggtcttcatccaccgccaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtcacagtcaccaccatcggctatggggacaaggtgccccagacgtgggtcgggaagaccatcgcctcctgcttctctgtctttgccatctccttctttgcgctcccagcggggattcttggctcggggtttgccctgaaggtgcagcagaagcagaggcagaagcacttcaaccggcagatcccggcggcagcctcactcattcagaccgcatggaggtgctatgctgccgagaaccccgactcctccacctggaagatctacatccggaaggccccccggagccacactctgctgtcacccagccccaaacccaagaagtctgtggtggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctgtaaggaagagcccaacactgctggaagtgagcatgccccatttcatgagaaccaacagcttcgccgaggacctggacctggaaggggagactctgctgacacccatcacccacatctcacagctgcgggaacaccatcgggccaccattaaggtcattcgacgcatgcagtactttgtggccaagaagaaattccagcaagcgcggaagccttacgatgtgcgggacgtcattgagcagtactcgcagggccacctcaacctcatggtgcgcatcaaggagctgcagaggaggctggaccagtccattgggaagccctcactgttcatctccgtctcagaaaagagcaaggatcgcggcagcaacacgatcggcgcccgcctgaaccgagtagaagacaaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctaaaaaaaaaaaaaaaaa

SEQ ID NO: 12756 - DNA, 4804 bp, Homo sapiens
gtttccggccgccgtcgctgtccagggaggctgaggcgagaggtagctgtccgggtggggagcccgcactaccttcttcctcttcctcctcctcctccgggtgaggggagcgaaggttgggggtccccgagcccatggaccaggaggaggcggaggccgccgagagccggggccccgctatgtggccctgagccccgtgtactggttctgcctgtctggagggccatggagaagaggctgggagtcaagccaaatcctgcttcctggattttatcaggatattattggcagacatctgcgaagtggttgagaagcctgtacctgttttatacttgcttttgcttcagcgttctgtggttgtcaacagatgccagtgagagcaggtgccagcaggggaagacacaatttggagttggcctgagatctgggggagaaaatcacctctggcttcttgaaggaaccccctctctccagtcatgttgggctgcctgctgccaggactctgcctgccatgtcttttggtggctagaagggatgtgcattcaggcagactgcagcaggccccagagctgccgggcttttaggacacactcctccaattccatgctggtgtttttaaaaaaattccaaactgcagatgatttgggctttctacctgaagatgatgtaccacatcttctggggctaggttggaactgggcatcttggaggcagagcccacccagagctgcactcagacctgctgtatcttccagtgaccagcagagcttaatcaggaagcttcagaagagaggtagtcccagtgacgtagttacacctatagtgacacagcattctaaagtgaatgactccaacgaattaggtggtctgactaccagtggctctgcagaggtccacaaggcgattacaatttccagtcccctaaccacagacctgactgcagagctgtctggtgggccaaagaatgtatcagtgcaacctgaaatatcagagggtcttgctactacgcccagcactcaacaagtaaaaagttctgagaaaacccagattgctgtcccccagccagtggctccctcctacagttatgctacccctaccccccaggcctctttccagagcacctcagcaccatacccagttataaaggaactggtggtatctgctggagagagtgtccagataaccctgcctaagaatgaagttcaattaaatgcatatgttctccaagaaccacctaaaggagaaacctacacctacgactggcagctgattactcatcctagagactacagtggagaaatggaagggaaacattcccagatcctcaaactatcgaagctcactccaggcctgtatgaattcaaagtgattgtagagggtcaaaatgcccatggggaaggctatgtgaacgtgacagtcaagccagagccccgtaagaatcggccccccattgctattgtgtcacctcagttccaggagatctctttgccaaccacttctacagtcattgatggcagtcaaagcactgatgatgataaaatcgttcagtaccattgggaagaacttaaggggcctctaagagaagagaagatttctgaagatacagccatattaaaactaagtaaactcgtccctgggaactacactttcagcttgactgtagtagactctgatggagctaccaactctactactgcaaacctgacagtgaacaaagctgtggattacccccctgtggccaacgcaggccccaaccaagtgatcaccctgccccaaaactccatcaccctctttgggaaccagagcactgatgatcatggcatcaccagctatgagtggtcactcagcccaagcagcaaagggaaagtggtggagatgcagggtgttagaacaccaaccttacagctctctgcgatgcaagaaggagactacacttaccagctcacagtgactgacacaataggacagcaggccactgctcaagtgactgttattgtgcaacctgaaaacaataagcctcctcaggcagatgcaggcccagataaagagctgacccttcctgtggatagcacaaccctggatggcagcaagagctcagatgatcagaaaattatctcatatctctgggaaaaaacacagggacctgatggggtgcagctcgagaatgctaacagcagtgttgctactgtgactgggctgcaagtggggacctatgtgttcaccttgactgtcaaagatgagaggaacctgcaaagccagagctctgtgaatgtcattgtcaaagaagaaataaacaaaccacctatagccaagataactgggaatgtggtgattaccctacccacgagcacagcagagctggatggctctaagtcctcagatgacaagggaatagtcagctacctctggactcgagatgaggggagcccagcagcaggggaggtgttaaatcactctgaccatcaccctatcctttttctttcaaacctggttgagggaacctacacttttcacctgaaagtgaccgatgcaaagggtgagagtgacacagaccggaccactgtggaggtgaaacctgatcccaggaaaaacaacctggtggagatcatcttggatatcaacgtcagtcagctaactgagaggctgaaggggatgttcatccgccagattggggtcctcctgggggtgctggattccgacatcattgtgcaaaagattcagccgtacacggagcagagcaccaaaatggtattttttgttcaaaacgagcctccccaccagatcttcaaaggccatgaggtggcagcgatgctcaagagtgagctgcggaagcaaaaggcagactttttgatattcagagccttggaagtcaacactgtcacatgtcagctgaactgttccgaccatggccactgtgactcgttcaccaaacgctgtatctgtgaccctttttggatggagaatttcatcaaggtgcagctgagggatggagacagcaactgtgagtggagcgtgttatatgttatcattgctacctttgtcattgttgttgccttgggaatcctgtcttggactgtgatctgttgttgtaagaggcaaaaaggaaaacccaagaggaaaagcaagtacaagatcctggatgccacggatcaggaaagcctggagctgaagccaacctcccgagcaggcatcaaacagaaaggccttttgctaagtagcagcctgatgcactccgagtcagagctggacagcgatgatgccatctttacatggccagaccgagagaagggcaaactcctgcatggtcagaatggctctgtacccaacgggcagacccctctgaaggccaggagcccgcgggaggagatcctgtagccacctggtctgtctcctcagggcagggcccagcacactgcccggccagtcctcctacctcccgagtctgcgggcagctgctgtcccagcatctgctggtcatttcgccctgacagtcccaaccagaacccctgggacttgaatccagagacgtcctccaggaacccctcaacgaagctgtgaatgaagaggtttcctctttaaacctgtctggtgggcccccagatatcctcacctcagggcctcctttttttgcaaactcctcccctcccccgagggcagacccagccagctgctaagctctgcagctccccagtggacagtgtcattgtgcccagagtgctgcaaggtgaggcctgctgtgctgcccgcacacctgagtgcaaaaccaagcactgtgggcatggtgtttccctctctggggtagagtacgccctctcgctgggcaaagaggaagtggcacccctcccctcaccacagatgctgagatggtagcatagaaatgatggccgggcgcggtggctcacgcctgtaatcccagcactttgggaggccgaggcgggcggatcatgaggtcaggagatcaagaccaccctggctaacacggtgaaaccccatctctactaaaaataaaaaaaaaaattagccgggtttggtggcgtatgcctgtaatcccagctactcgggaggctgaggcaggagaattgcttaaacctgggaggtggaggctgcagtgagccaagatcgtgccactgcactccagcctgagtgacagagcaagactccgtcaaaaaaaaaaaaaaaaaaaaagaaatgatatctggcccccccttaacactggagccccactcccttctcccatccggcccgagattagggaggattgactgtgtcagggatggcgggtggcctctctcgctgccagggcccttgtcagagcagccaggctggacagacggcctccctcctctccatctgaccggcacctgctgcttcggggcttaggccaccgctccctgtccccagaggagatagccccagatggactggaatgttgtggcatgagagcgcatgtgtgcgatggccccgctgtggtcccctctctgtccctccatctgtatgtgttctgtgtcccttgcatgtgtgcgtgttagagtgagcgcgtatgcatcaactcattgggctcttggctgctcacaaggcaaatttgacttggaaagactttcatctccttggaaccaagacttcctgagtccccctcaccctggccctgttccaccatggttatctgggtattggggaatggaaactttgggggagtgactttttaaagagacacttataatttctactactgcactactgtccattgtgggatgattaaacatggtatttaactgtgcaaaaaaaaaaaaaaaaaaaaaaaaaa

SEQ ID NO: 12757 - DNA, 4144 bp, Homo sapiens
atgggccgctggttgaacaagcttgctgtagatgaaaataatgcaaccaatggcgaggtgccagaaacgagcatcagggaaagggcgggacgaaagtgttcgcgggagggaggggaaggcccagggaaccaagcagcgctgtcgccgccgccgctgcagccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtctcaacaaatggcagctattacatcagacagtgacgagtcctgctgctcccttacagtgtctgacagaccactgtggattcagactgggagcattgaagttaacagtgaaacgggcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagtttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgatttttta

SEQ ID NO: 12758 - DNA, 4145 bp, Homo sapiens
atgggccgctggttgaacaagcttgctgtagatgaaaataatgcaaccaatggcgaggtgccagaaacgagcatcagggaaagggcgggacgaaagtgttcgcgggagggaggggaaggcccagggaaccaagcagcgctgtcgccgccgccgctgcagccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtctcaacaaatggcagctattacatcagacagtgacgagtcctgctgctcccttacagtgtctgacagaccactgtggattcagactgggagcattgaagttaacagtgaaacgggcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagttttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgatttttta

SEQ ID NO: 12759 - DNA, 3549 bp, Homo sapiens
atgccggccctggcatctgtatatcatttttatactgctaccagtagagcaatttcaaaagtatttgcaaggaaaatgcgtgtccccatctgttcctggaagcataaatgtgccaccttcagagggttttcactggaggatgaggctgtcactactacagttgggactgtttcatactccgtgctcttgtgctatgccagggggtactgtctaacccacaagtctctgccaggaatgttgctgtccacactggagtggggcctggagtgggggggcttgcgggtagttgatatcaaatcccggtctctctcacttccgctcaatcggcttttggccaaagacgagtatcttcttcctggactgccttctcccaccccaacccagacaccaaggggacgcgacagcggttttgggacgctggctgatcatctgagaggaggcgatcccggccccgctgggcgttcaggatcccgatctggatgccgtccaccccgccccgccgggggctggggcgaaagcggaacaagtcggcggggctggttgggccgcgacctccggggcacgtggccgcagacagtgcccgtgccggggcggggaggcgagttctccctgcggccgcggaccctggatggtggcgtcgcccgaagacgcgcctcaccggcctgggtggggttgccttttgccctcgaggctggcctaagcgctggggggccgctggctaaccctgaggtagatactcgggaaatgggtggaatagggaaagggactcagcccttccgcccttttccccagtcgaggcccgcgtcactgccctgtgggtgcagacgcctccagtgtcactcccctggatttcgcttgggcagaagaagagattgtaggccggaccccaacgccgaagccctgaggcttctaatgtgaggaaaaacacggaatgacaagtgtgggaaagagcaagcactaaattactgtcagaaaaataaacggagtagcacagtgctgctcggtgatttacgggggcaattagtcaccaccccacggcgctgctgaggacagcacggcagcagacaagtcaggcccatgaggaagaagaggctttgcactgctctccagacaacttttcaaacaacaagagaggatatttgagcacattaggttttgtgtcttcattctgggtacctactcttcatattattctaccaacttaatacataaacatatttttagcacaatatgaacctgttctatgtgtgtttaaaagcctccagcagcaacttttttctctcccactgtccaaagttgggttttccccatcccttaaaaaacaaaacaaaaaaacctttcttcactccaaattgtccccctggtgtgtggttttggtctttctcattacttcttgcatcttgctacatgttctgcatttgctcagagccactgggtgctaaggaatttggtctgctgctcctctgggaaagtttggtaagctggtacaaggaggtgatgaacaaggctaaatgaaaatcatacataaacttcccaatatttgtgaacatgttctttaacataccatacatagtttctatgtatatgtaacatagcaaaacaaacttgctaaggtataattaattggtatgcatgccttcataaatattcaccatcagaagaaacctagaatgaaaggttgtgaaagaacccaggaatgagaaagactttattgactaaaggccatgtctatgtaggggcaacaatgaagctgtgggtgagcaaatgaagcttcatcaggagtttagtatccttatgtagcattacctaagaatgctaccatagtaaatttctgaagtactttacctgttacaaagaacgtttgtaatctccttttcttatttgatcttgccctggctttagtcaggaacacctgctcagttagaaatgtattcggtgggtatgtacgcagttggagaatgtgccccaacacacgccgcctttggcctgtatgttggagtcctagagaggcagacaatgttgatgagcttggtaccagcatggtgcgccattcatccggacacaatttctgataaagagggtcacaactgggagaaacctcagattctacttgcttctcttctccacgttattagactttttttcccctcttgaattttataagcacactccttttaaaacaattaattaataacgagcactgggatttgatgtagaattgcgtatttgtaactgcaatggcactggttttcaactaccctgtaacaaggaagcaattctaaccagcaaaagaggcagacgtgtttctgtgcaacatcacaggcgtgtgaaattgttcagatattgagatatcaggagtgatataaattggaaatttaaccaaaaatattttccatcagtgaacaaagccgattttaaagtgcctcttgcatttttcagatctttctctttctttttcccaaagtcacattgtagtttctgataaaggaacacactgggaaaactaagcacatatttaatcaatgaaatttaaggtgtaaaaattctgcatttctgacaaatttaatgttcacttttttcttgatttaaatagagcattctaaaaatattacccctataggggataaatttttatatgcatgttatttttctttacaaagtgtgggctagtaaagagtgaaaaagaccttggctattgtacttatttcttgaaagaaataatagcatcttaatgactggattcaaatctctgcttatcacacaacttccgtacagttcaaagagaggacttggattgaatgaaaacagagagctggggcttcctacattcccctgtgtttgtgttcatacagaatatttatgcaatattctgacttggccataatctgtaattcctgcctattattctcagttgcaactataaattctagattaatggttataattttggtaaggcatacatgaaaagttatatgttcctgcttgaaaggaggatcattaaatattcattattaccactcaaattagttgtcatgctctgtgtaatagttacccgttatcatttcactagtttggattcagcagtaagtgaacagcaatatatagctcatagcgccagaggactttttttgtcggggaacagggagagaaatgattttaaaacccatttgacatatttatgttgacaaattatttaaaggaattactgtgttgtaataaacatgtttgtatgttggaataggattgtggctaaatttgcttctagctgtttaattactcttattatgattgtgaaaaacagtgcttcttcaagtagttccaaggaaaaaaatagaaaatggaaaagttgagctatttcagtcttttgcaggtatctaaccttgccatgaaaaagcacttttcatttttgtaagtagatattgaaatcttgctttttcagcgaagctagattgtataatttattagttttctccacctggtaacacatccttaagaaaaaaattgccaaaagtaaagcatgagatggattttaaaataaatgttgtggat

SEQ ID NO: 12760 - DNA, 3549 bp, Homo sapiens; identical to SEQ ID NO: 12759

SEQ ID NO: 12761 - DNA, 4156 bp, Homo sapiens
gagaatgtgagaaaagggggaaaatgcccaggaggaagcaggagcagcccaagcgccttccctcacatgttagtaggcaggaagaggcggagggggagctcagtgaaggagaacactggtatggaaactcttcagaggctccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccggcagctcagtgttctggccaggaagttggccgagaagcaggaacagaatgaccaatacactccaagtaaccgttttatatggaatcaaggtaagtggttgccaaactcaaccaccacctgcagcttgtctccggattcagccatcctaaaactgaaagctgcagccaatgccgttctgcaggacaaatctctcaccaggactgaggagaccatgcgatttgagtccctttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagccctttcttttcagaagacacatttagacaatcaccattcacctccaattcaaaagaactgctgcccagtgactccgtgctgcacggaagaatatcagctccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacagaggaaagaaaatacaaatgccacttgtgcccctatgctgctaagtgccgtgcaaatctgaaccagcacttgaccgtccattccgtgaagctggtgagtacagacaccgaggacattgtcagcgccgtcacctctgaaggcagtgatgggaagaaacatccttattattacagttgtcacgtgtgtggatttgggaccgagctcaatgtccagtttgtcagccacatgtcactccacgtggacaaggagcagtggatgttttcgatctgctgcactgcctgcgacttcgtcaccatggaggaagcagagataaagactcacattggcaccaagcacacaggggaagacaggaagacccccagcgaatcaaatagcccctcttcatcctccctctcagctctgagtgattcagccaacagcaaagatgattcagatggctcccagaaaaacaagggcgggaacaatctgctggtcatctctgtcatgcctgggagccagccctcactgaacagtgaggaaaagccagagaaagggttcgaatgtgttttttgcaactttgtctgcaagacgaagaacatgtttgagcgtcatctgcagatacacctcatcacccggatgtttgagtgtgatgtgtgccacaagttcatgaagacccccgaacagctgctggagcataagaaatgccacactgtccccaccggtgggctcaagtaaggaaactcaggacagtggtgagtttcagactcctctaggtgcccattctgcatttattccaccaaccgccccgctgccatggagtgccacctcaagacccactacaagatggagtacaagtgccggatctgccagacggtgaaggccaaccagctggagctggagacgcacacccgggagcaccgcctgggcaaccactacaagtgcgaccagtgcggctacctgtccaagaccgccaacaagctcatcgagcacgtgcgcgtccacaccggggagcggcccttccactgtgaccagtgcagctacagctgcaagcgcaaggacaatctcaacctgcacaagaagctgaagcacgccccacgccagaccttcagctgcgaagagtgcctgttcaagaccacacaccctttcgtcttcagccgccacgtcaagaagcaccagagtggggactgccccgaggaggacaagaagggcctgtgtccagcccccaaggaaccggccggcccgggggccccgctcctggtggtcgggagctcccggaatctcctgtctcccctgtcagttatgtctgcctcccaggctctgcagaccgtggccctgtcggcagcccacggcagcagctcagagcccaacctggcactcaaggctttggccttcaacggctcccctttgcgctttgacaagtaccggaactcagattttgcccatctcattcccttgacaatgttataccccaagaaccacttggatctcacattccaccctccccgacctcagactgcgcctcccagcatcccctcacccaaacactccttcctggcctatctcggactgagagaaagagcagagactgtctgagggcagccatgttctgtaccaaaaacagagagacaaaagac

SEQ ID NO: 12762 - DNA, 1748 bp, Homo sapiens
cgctgctgctgccacgtaagaagtgtgttgcttccccttcgtcttccaccatgaataacagaatggcaattttcgtgtggtgttaatttccgtggaagaagaaaaggctcgactctctgtcctatttttcatgaatactggaagtagggaataaacctggagtctcacgggtgaaaagagacatttccatatcaccagaccacaaacgtgggtgttgattctaaggatacccccaataaacatctttcgtgctaaagcccattccagaatttacttcccagctatctttgatgttcatattgtcagaggtggtggccgctgaaacaggcaaagacatggagcatatcttgggtccaggtaaaggaggtgggtgcacacaagtgaaaagatgttgctgaagtcacgtggcttcaagcagtagagctgactgtcctctagtccagttgtccctacaggataaaagcttctctccattacagagaccttgggagtccagaggaaggtctttttaccatcagcattctctactgtgttcaatgactgtcagccaaagatggccaggttctctactgtgatggtgaattttatgtgtcaatttgactggaccatgggatgcccagctttccttcagaaagaaatgcattcaaagaacctacattcacaacataaagaaataaagcctgcacctacagatctacacacatgcccatgcacatgcaggaagtgttcatctaagactggaccttttagaagaaagctggcatacattcgtgaaggcatgggcttccaggcatgtcatcttcactcacgaagcacacacaagaccgccaagcattaagattctcctgtggagccaggctacaatcctttaaatgaagacagacagctaggtggctgcagcccagcgctacacctcacccctccctcagtgtcatgcagaaaaaatgtattcagaactcagaagtgaagttgtgcaaatccatcattgacactagcttcaaggttacctcgggggagcagaatgtacccctgccagagagctggatagatgatgatggggacagaaattctgggggagttgtaaatggcagccactgcctctataggaaacccaaagggaacacagcagaagaggaggtggtggaggagccactgccctctcgaagggttcaatgtcattctgcagacacaaccaaataactttttcttccctgctgctcctccatttgaaatgacagccccgagctcgctttttccttgattgtgtaactctgattacagacaaggccaaggcaatcccagggcattactacaaagctaaggggtccccaaagaactaaagagtcagctccacaaaaatcccgattcctagcatgaaactgaaatatgaaaccaaacgggcatagaaaaggtatgtgcattcgaatcacatagcagtgactggagtcctgagctgtgtctgaagactgtgagatcacgtttggagctgctgattggttttcagtgatggccctgttgcacagtgccgtgagacttagctccatggccaaagacgatggtatcccctaggagccctgtgaggttgctgctgttctcttaagacaccaggtagccatctgatcctccctgagcaaactaactgggcagacaggtttattaaacctctgttggtccgacttacatgaaacaagagagttattttgttgttgttgttttgttttgttttaaattaaacctgtctttggagc

SEQ ID NO: 12763 - DNA, 1748 bp, Homo sapiens; identical to SEQ ID NO: 12762

SEQ ID NO: 12764 - DNA, 3655 bp, Homo sapiens
atggcgcagcagctgtgcggcattcagttactaaagatggtgtggaatgtgaagggtcctggaggtctgccagagtggatctccatcctgcaggggctgaggcacccagctgctaccagtactaccaccatgaggctccaactcatcctaactgccctgagaggtttccatgatcaaatccaggagcaggaggcagaagagctgaggctcacaaatggcccatccgggcttttccgtggagcccgtttctgcccgacccccctgaggaatgggacccgagaagggcgcactcgcacgggccgcggaggccaacgccgagcctgcgcggcgggaggcgctgagaactcactgcgcacgcgccggtcggctggccgcacccacgcggcgcagctcccaaagttgcagacagcccggcgaaccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccaggtggtcaggctcaggatggaccatgagctttcaaaaaggaaaaaggtggaaatcctcaactatgctgccatctgaataagtgtttctttgtagatgcacagagtcaaggaaaattacatccctgcattatgtaatgtaccaacaacgcacttacccactgttttaatctaggttattcttgaaagcagagcctgagacaaaggtagacacattctatttatgagtctaacacccaggagcaggaatgagagataggggagtgaactggggaaaagggaaactaagtccgagcaaaaccagatactgctcttatcaagtggtccacccctattaatggctacataatgcagaactttctcaggattcttcttaaactttatctcagaactgtctgcctcagggagaaaggagaagtatttctccatcagcagccacctcctgtgtgttgagggctgctcctttggggcattaacccactgcctccaccaccccaaccctctgggctgcaaagagctagctgacagtccagctggtaccttagcatcacacattgctgcatcagagaggtcttaagacaggaagctagagtcttggtgcatgctcgaagtgagacggtgtcagcacagagcagggtaaaatcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaatatatgttaagtttctactatgtgctgtgtattggtactataaatatgaataagacataagatattacattcaaaaacatcagaatacatgttcttttaaagtataccccaaaacatttaccatgtgttctggggcgcatgttaggctggatcacaaatcaagtctcaagaatttcaaaagattgaaatcatatagagtatgaattaaaccagaaatcaagtacataaaggtaacaaaaaatttccaaaatgcattaatttaaggaacatacacctcatgacccatgagccaaaaaataaatcacggcaaaattgcaaaaatattttgaaatgaattttaaagaaaatacttagcatattaaatacttagcatattaaagctctaagtacatatgttagaaattttaccgaaaggttggctatcagtgtttccagaagccagggaaaaagtttatacaatttgatcgctgaggcagggaaacaaagtgagacctccgatcgccctgcctttctgaggtgagcactctggatcccatcgcaggagatcagagtcttgctgagttgaggagaggaagattggagttgatactgagatagcttgaattttcaggacaaagtatcaacaaggaggaaggtagacaaaaaaatccagaaatctatgtagagaccccattgtgtacattgcggaacactaagcctaacaattctcaaaattagcgtgagattgggaaatatctaatttccatccagccacagtggagagtcctgactgaaaaccaggcattcgctaaagatcccagaaaggttgtgtgttacatacgtagggctaaactatcctgactaaaaactacactacacttgctcctcacccccacaaaaagcttaaaaacaagcctcaatagtataaagctgatctgtaagtaactaaactacctgcagaacaaagtccaaatttattagttccagtactccaaaaaaaacacatgtaaaaaaaaaatagatttacaagacatttatttggggaaaaaaagaatgcctgagggttgaaatggagaggaagccagagagacagagtcctcagaatacataaaatttctggcctccatggaggtgtgatggttaattttatgcatgtcaacttcgctgggccacaggatgccccatatatgatcgaacattatttctggttgtgttcatgaagctttttctggaggaaattcgcatttgaattgatggactgaataaagcagattgcagtccccagtgtggatgggcttgatccagtcttctaaggacccaaataaaataggtggaggaagcttgaattttctgcctgactgtggcgctgggacacccatcttctcctgcccttgaactgggactgacaccatcagtgctcctggttctcagaccttcggacagcagacttggggccttctcggcctccattattgtgtaagccaattccttataataaataagggtttatttattgataaatccttataggttgat

SEQ ID NO: 12765 - DNA, 4484 bp, Homo sapiens
atgacaaggggaagtcaagctgtgaaggcaagagggagaggagccaaggaggttcctgtgggtcagaggaaagtgactgtggaggaagtctttgtccagggctttgggtgttggcgtcagctcctcacgcagcagaaactggatttgtcatcctctttctttagcctgtcagctgccatggacttgggggtaggtttgcatagacctggctaccacgaaacatgtggggagccagatcaggagctgaaagaccaagaaatgagcaaagggaatgaagcatccatgggggaggtcctaggtggctgtcacttcctggaatggtgtgactcacctttcagacacttacgcatgagtacgggacacgtcaaaaacataggcacgtttagagcgactgtcagcggaaagctgtccatcacatgcactaaggaagggcagctgctgcagtggatggctgcttctgtgaggtgctcttttgacaatgagagccctgctagcatcagaagcaaaactgaaatgaaattaaaagagagcactgggttgggtcttgaggctgaaccaagctcagatgtgagtctgtctgagctctggctcctagcctcaaaactacccatgaaggggaaaattatggcagggacaaaagaaagtacctctgagacctatggttaccatgaaagatttcattctagtgaggggaagaaaaaggacaaagaggaaaagtcaaagaaagtcattttggatcatgataaatgctctgaacgagggctgggagatgcccttagaggaaatgatgtgagctttaagccaggactcaatagccttgctactgagttaaccaagaaacaaaagactattgagcaggaaacgatggtgtggaatgtgaagggtcctggaggtctgccagagtggatctccatcctgcaggggctgaggcacccagctgctaccagtactaccaccatgaggctccaactcatcctaactgccctgagaggtttccatgatcaaatccaggagcaggaggcagaagagctgaggctcacaaatggcccatccgggcttttccgtggagcccgtttctgcccgacccccctgaggaatgggacccgagaagggcgcactcgcacgggccgcggaggccaacgccgagcctgcgcggcgggaggcgctgagaactcactgcgcacgcgccggtcggctggccgcacccacgcggcgcagctcccaaagttgcagacagcccggcgaaccgcgcaatgcgcttcttctgcctgcagcagagaaaaggaaagaaaactccgcaggggctccgttggcttctccacgagtgacaaccatgttttcccagatagaagaccggagccctgctcctttgcgatccgccgagggctgcagagagcatcctcatccatttgggcacccctgcccaggaagagcccggccatccctttccggactggatccttaagaggtgaattttcttccgtggattccgatttgctccgtctgaccagcctaggcaatccagcatcgcgtggtaccagtgccgctgggcacactggcttcacgccggctccgcctcaccagcaagcgcattcccaggtggtcaggctcaggatggaccatgagctttcaaaaaggaaaaaggtggaaatcctcaactatgctgccatctgaataagtgtttctttgtagatgcacagagtcaaggaaaattacatccctgcattatgtaatgtaccaacaacgcacttacccactgttttaatctaggttattcttgaaagcagagcctgagacaaaggtagacacattctatttatgagtctaacacccaggagcaggaatgagagataggggagtgaactggggaaaagggaaactaagtccgagcaaaaccagatactgctcttatcaagtggtccacccctattaatggctacataatgcagaactttctcaggattcttcttaaactttatctcagaactgtctgcctcagggagaaaggagaagtatttctccatcagcagccacctcctgtgtgttgagggctgctcctttggggcattaacccactgcctccaccaccccaaccctctgggctgcaaagagctagctgacagtccagctggtaccttagcatcacacattgctgcatcagagaggtcttaagacaggaagctagagtcttggtgcatgctcgaagtgagacggtgtcagcacagagcagggtaaagtcttcccgttaactcttcaccagagctatgactggaatcagaggttgaaaagatgtgagactgtacccaagaagcatcttataagcctacgtaatatactgttagactcatcgaaatctatttcctcccttctttataatcaaaacttcagtgtccagaataaagttggcagaagggttaaattggaaagttaaatgtactagaaggtgtacatttataagttttgaccttgagtcgtgttcaaggagaaagtgacattggaacttggaaaatttaaaaatgattctacttgaaaaatttgaccattgcatagaaatattagctatcgtctaatcttttgtaatcttagaaacaatcgtgaattgtttggtgaaaaatgaaaaaataaccatttcttatgtctccgtgacctttatagaccaatgtcaccaacttttcctaaggtaattgtttcctactgtcaaatagctctagtgatataaatcttaacaatcaatgaagggaaaactggtggaaacataggaggaaaaatactgggataattttcatcacaaagtattggcattaacattggttagaataggggagaaactgcatgacttgacaactggacattcctgtatgttgtatgaggccctgtcttaacagaaatagtgatgtcatcatcatcctctcttatttggtcttgaattgccaccaatcggataaaacctttgaattatttaactcaatatatgttaagtttctactatgtgctgtgtattggtactataaatatgaataagacataagatattacattcaaaaacatcagaatacatgttcttttaaagtataccccaaaacatttaccatgtgttctggggcgcatgttaggctggatcacaaatcaagtctcaagaaatttcaaaagattgaaatcatatagagtatgaattaaaccagaaatcaagtacataaaggtaacaaaaaatttccaaaatgcattaatttaaggaacatacacctcatgacccatgagccaaaaaataaatcacggcaaaattgcaaaaatattttgaaatgaattttaaagaaaatacttagcatattaaatacttagcatattaaagctctaagtacatatgttagaaattttaccgaaaggttggctatcagtgtttccagaagccagggaaaaagtttatacaatttgatcgctgaggcagggaaacaaagtgagacctccgatcgccctgcctttctgaggtgagcactctggatcccatcgcaggagatcagagtcttgctgagttgaggagaggaagattggagttgatactgagatagcttgaattttcaggacaaagtatcaacaaggaggaaggtagacaaaaaaatccagaaatctatgtagagaccccattgtgtacattgcggaacactaagcctaacaattctcaaaattagcgtgagattgggaaatatctaatttccatccagccacagtggagagtcctgactgaaaaccaggcattcgctaaagatcccagaaaggttgtgtgttacatacgtagggctaaactatcctgactaaaaactacactacacttgctcctcacccccacaaaaagcttaaaaacaagcctcaatagtataaagctgatctgtaagtaactaaactacctgcagaacaaagtccaaatttattagttccagtactccaaaaaaaacacatgtaaaaaaaaaatagatttacaagacatttatttggggaaaaaaagaatgcctgagggttgaaatggagaggaagccagagagacagagtcctcagaatacataaaatttctggcctccatggaggtgtgatggttaattttatgcatgtcaacttcgctgggccacaggatgccccatatatgatcgaacattatttctggttgtgttcatgaagctttttctggaggaaattcgcatttgaattgatggactgaataaagcagattgcagtccccagtgtggatgggcttgatccagtcttctaaggacccaaataaaataggtggaggaagcttgaattttctgcctgactgtggcgctgggacacccatcttctcctgcccttgaactgggactgacaccatcagtgctcctggttctcagaccttcggacagcagacttggggccttctcggcctccattattgtgtaagccaattccttataataaataagggtttatttattgataaatccttataggttgat

SEQ ID NO: 12766 - DNA, 4086 bp, Homo sapiens
ggcagccccaactcttccaccacctcctccatctccggctcctgggcttgggaggccccgcgccactgcttcgactggctggggcgggaaggttgaaatggctttgagactccacttttgagcttactcctcctttgcccgactattttctcatagtccctattccaatcaatttctggtgcagcccagcttgaaatggctcttgagcctccgcttttcagctgactcctcgattgctcaactattttctcatagtccctgttccggtcaatttccggcgcagcccagcccagtccggcgaggtctggaaaggcctgactcgcctcgcagcctgaatgacttgtacccaccgccgatgcggacctcccagtcttcttggcgactgtggggtggggggcatgcggttgaagccgttcacacgggcagtccctgcatgtcccctcacgtgctccccagtgcacgcggcacccccgcctccacgcttccctgagcgtgcagcctttggtgagggcagccccacgcacagccccccacaccctccccagcgcctgcagcccctggtgcacgcagtccccaagcccgcacgtgcagcccccaccttgcacacagctccatgtacagcccctcatacgttcacagccccagtggcgcagaacccatcactactcgctcttcacgcgcttcactgggcgtgcagcccccacagcgcgcagctcaatgcagcctctccacgtgctccccagggcctgcagcctcgtcttaacttcttttgccaggcccacacatacctgcctatggcctgagtggattggcaatgacagtggtgacagctgacatttactgagtacatgctatgttccagatgctgcgtttccattctccaatgaagaatcttaagtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaagatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgtactggagctggagaatttgtttctaaggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggcaaagaaaaaagaaaggaggaaggggtgttggagcagattgtagttgatccacagcaaagagcatcaccaaagccattccaggaggaactagatccaccacttcctctgctgggcatgctccaaaaatggttgtggcctccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgactccaagcacatccaggaatgcacttactgataagatattgaggcaagctgtaccagcagctcctggggacgtgctcagtggatggtacccaagcccctgcatttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaattagt

SEQ ID NO: 12767 - DNA, 2279 bp, Homo sapiens
agcattgacatcttagtatccagtgtagaagcatcaacgtcttggtgtccagtgtagacagcatcaacaccttggtatgcagtgtagacaccatccatatgttggtatccagtgtagacagtatcaaagtcttggtatctagtgtggacagcatcgatgtcttgttgtccagtgtagacagcattgacatcttggtgtccagtgtagacagcatcaacatcttggtatacagtgtagacagcatccatgtcttgacatccagtgtagacagcattgacctcttggtatccaatgtagacagcatccatgtcttagtatccaatgtagacagcatcaaagtcttggtatctagtatagacagcataaacttcttggtatccagtgtagacagcatccatgtcttggtatccagtgtagacagtatcaaagtcttggtatctaatgtagacagcatcgatgtcttagtatccagtgtagacagcattgacgtcttggtgtccagtgtagacagcattaacatcttggtatgcaatgtagacagcatccatgtcttggtatccagtgtagacagtatcaaagtcttggtatctagtgtggacagtatcgacgtcttggtgtccagtgtagacaccatcaagatcttggtatccagtgtagacagctccatgtcttggtatccagtgtagtggcattaatggctcatatgtgtgctcagccaatccttcctcggctgattcttcactcctttcagaccgggctcacagatgtagcatcaaatgttgacactgcccccaccccccattccacaggaatccctacctcgttgactttgcttttctgttctccatgtaacttctctccccttggcacatcccacacatgtctcccctcactggaataggagctacctgaagaaagagagtcccccttttctgtttactgttgaattccaggcatgagatcaaagcccaccatggggtaggtgttcaataaatatgtattgctttaacaaaaaaggcattctgatacataatctatccgttgaacatagcacttcaccttagcttttaacaatattataagtgcatccacccgatacgcccacccaccccagcagcacaaaaataaatggatcaaaacaagcaatagaacaggagccaggcccggtggccacatctgtaatcccagcattttaggaggccaaggcttgagcccaggagttcaagaccagcctggcccatgtggcaaaaccccatctctacgaaataatttaaaaaattagccggacatggtagcatgcacctatagtcccagctactcaggaggctgaggtggtaggatcactcgagccagaaggttgaggctgcagtgagccatgatcattccagtgcactccagcctgggtgacagcgtcaagaaagaaagagagagagacagagagagctttggaattgagagttccatctataatggtatttgatgattactggttttgtggcaaaagctttcagtgttctagcctggctttgggctagattccagtgaagaagggactgtagggggtgggggagtcattagtctgagattcacagtaattacgataattacaatagaatcacaaaggactctaaggtgtcattgattctatccttcatctccaaggtctccagatagatgtatgcatatgaaattcaaccaagaaatgattcccacagttagtttaagacacctttcaaattttagctttggtttgaaaataatcattcggcaatgggtgtcctcagtggttgaaaacaacagccagaaatcacttctggtgcctgcacagtggctcacccttgtcatcccaacactttgggatgctgaggagggaggattgcttgagctcaggagttcgagacaagcctgggcaacatagtgagaccccaactctaaagaaatgtcaaaaaatttgctgaatatcatggcacgcagctgtcattccagctactcatgaagctgagacaggagaatcacttaagcccaggagctcaaggctgcagtgagccgagattgtgccactgcactccagcctgggcaacagagcgagatcttgttgaaagaaagaaagaaaaagaaagaaagaaaaagaaagaaagaaagaaagaaagaaagaaagaaagaaagaaagaaagaaagaaagaaagagagaaagaaagaaaagagagagagagagaaagagaaagaaagaaagagtgagagagagagaagagagagaaaagaaagaaagagaaaaaaga

SEQ ID NO: 12768 - DNA, 4289 bp, Homo sapiens
attaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgaggtgtgtgtccggcgagtgcgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtttctggaggctgctcacattccttggcttatggcctccttcttccaacgtcaaagccagcaacattgcagcaatctgacttattttgttgtcatgtctcctgaccacatctggaagggttatctacttttgaagacacatccagataattcaggacaatctgtccattttgaggttcttcattgaatcatgtctgcaaagtcccttctgcaatctaagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12769 - DNA, 3676 bp, Homo sapiens
gtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12770 - DNA, 3556 bp, Homo sapiens
ggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12771 - DNA, 3408 bp, Homo sapiens
aggggtgtgcggctggcttgtcccgcccctgcccctgagtgacagaaccgtggacagcaacatttcccacaggacacgaagtttgtcggcccttgccttggcagagctgaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12772 - DNA, 3622 bp, Homo sapiens
ctggcttgtcccgcccctgcccctgagtgacagaaccgtggacagcaacatttcccacaggacacgaagtttgtcggcccttgccttggcagagctgagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12773 - DNA, 3586 bp, Homo sapiens
gcaattctggcctctccagcctcttgcctttcttctgaggggagccttttatcctgctgtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12774 - DNA, 4070 bp, Homo sapiens
attaactaaacaagtcacagtctttatttttaatttctacagtcacctcgtgagacaggtattagaactccggagtggcatcaaaatgagggaaaggcctcagggccagcgcctttgcgtcctggaccggcgtacagacgggagaaaggccgaccaatccgagagcaggctgaggcctggtcccgcccctgggggcagagcctcgcctcttttccgcctcaccctttgggagtaggggtgtgcggctggcttgtcccgcccctgcccctgagtgacagaaccgtggacagcaacatttcccacaggacacgaagtttgtcggcccttgccttggcagagctgaggtgtgtgtccggcgagtgcgaggggattggggagaccctgcccgggaagctcggggtccgggaatgaaagcgggcgcacctctttagcgagccctaaagcgtttgggagacgatcgttccgtccctgggagcggcacttggtggggctgggcggagggaggctctgcaagagaaacccggagtccgggaaacccagtagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12775 - DNA, 3768 bp, Homo sapiens
cccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaagcaatatgaaacagaaaaacaagttggttggatagctgtcctccatgcagtcattcatgatccaggctgtcatcatcttcatcactcatgttcagagttaccctagaggtcatctccatttcatccagataaatgagtatgcaaggaacgtttttataggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12776 - DNA, 3656 bp, Homo sapiens
tccgcctcaccctttgggagtaggggtgtgcggctggcttgtcccgcccctgcccctgagtgacagaaccgtggacagcaacatttcccacaggacacgaagtttgtcggcccttgccttggcagagctgagtaagaaaaatcaccaagaatattatttttggtatttggaattgaatttgccaggaatgcaagcactgctacctaactaaagaccttggctttggaaacatcttaccccttggcagctctccagagtttagacttggcagcatcaaagacacaacgcaaggcattttggagatcaaagatgggtagaaaagatgctgctactataaaacttcctgttgatcagtacagaaaacaaattggtaaacaggattataaaaaaactaaacctattttacgagcaaccaaattaaaagcagaagcaaagaaaacagcaataggcataaaggaagttggccttgtacttgcagctatattggcactactactggctttctatgctttcttttatctcagactcaccacggatgttgaccctgatctggaccaagatgaagattagctaagcaacaatcaatgcatgaaagagaaataactttacgaaagcaccttttgggaccaaaactttcaatactgaaactgtaacatctttaattctttctgctaatattttcagtttgcagacatatgatttttgatagttgcataggatgtcaggaaaagaaccttacctagcaatgcagtatagtatgtgctactggatacttttatatatctttctgctttgacagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacattgtatttatgaagaataaataaaatattaagattgttttcctgctagccaagagaagaaatccttgggaaatatctaaggagtatatggggctttataagcactgtttctaaaagatattctctggtacttttgcaaaaagtcgactgtgactgtgtagcattatgttctgtagaatttttttcaagtagcataatttatttcattggtgtgaaaacagccaaaggttccaatatcctcacaaatcatttatgccaaacatctgagggcaaaatttagccggtgttatttactagattcttccctttgaactcacagactcaagagacagaccaagagttcttatatactcaccacagcggaccaatccaagtggcatttttaggaaaggttgcagcatttaatgccatgtggtatgtctgttcgtcaagtgggtggcaagggaatatccaagctggcattttggatatgatgggccttttactttcctgagtgacatgccacatgtcaagaaatactgctccccacccccccactcccatcacatttacgtgaacaattttcatttagttatttcccgttccatatggtgttaaaacagtcgtattaaataaagattatttctagttttcagtggtaatttaaatgagaggatatgtaataattgcttattagatacttatccaaatgaaatataacagagtttacagtacttaaaatggctggttatggtcttggaaatgtttgaaaattcattatcctgaaaaaaactttaccattctgttttacccttgaggtattttttggggaaaaatgtttttgataactattaatctaaatatagtataattataggcaaatttcactgcctagttttattgatatcctgagtctacagctagtccattcgtatgactgattgatttatgatagctccagagaaccataaatttcaaaggctaaactctctgattttagtaaatagtaggtaaagtgacacaatatatgtttacacaacactgttttcatgaaatgcaaactttgcaaaactcacattaactgggaagcagccaaccctctgtagagaaatcccagattgggagtctggtttgaatctttgaagacagaaaggtgatatccggcctgctgttttaaagggaccacacttttgaatacctactggtgtttggcagaaatctgagactggcaccagacacaaattttagacatgggtatcttccctccagtaattcactgctcagagtaatttagaagacaaaaacagaaaaaattgtaatgattttttaagtgttagaatatgtttgttaacatactctgcaaaataaatttcaactaatgcaatagacttaaaatatagcctatggaatactgtgattgaagtttgaaggcttgctggttcttattttgcatgcaagtttagacagggtaaagaatgtataaatttatttgagatgagatacagtattgtaaaaatataacctcatctagaattgcttttaaaacaagcaaaagcctattttagtacaaatgtagggtgggtagttgttttaaggtagcaaaatacttcaagattttctatctttttaatttttcatgaagacagaagaaatactttcaccccaaccaatgactgtaagatcttgagagtatgttcttactcatttctgtaattgcagtagtgtagtcatctgcatataaatttaataaatgcatgttaaaatttaagttgatgccttttagtcctctcagagtctgtcacagtttctttgtgtaaatgataaaaaagtttgaatttaatcaataaaacttaaaaatcacaatatc

SEQ ID NO: 12777 - DNA, 2709 bp, Homo sapiens
tacagttaattgtggataacttacatagaaaatttaatagaatcaacaggttaattagtagaatggagagtgcatacatagaggtataatagtcaacctgtaagacatcagatcaatttataaaatgcaacagtgtgcattgacctcagcagttactagggtaattatatgtcatggcttgggacagtctcagttgacacttgttgttctgacataatttttaatgttgttccccttttaccctcaaaagtattctgatttggatgataaattatactgtcacccttgctataacaaactaaatattaaacacagatacagataccattcatactgacaaaaacgatcctgtattttggaatgacactaagatatgaccatgaccatgtcatacaaagctatagagaagataccaagatgctcctggaatagggaagagccaggagagcagtggaacaagatctacagtgtggaaacaggtctgctgggcacttatagctttgaatggcagagtcaagttgcaaacaagacaatgaggaaaagaaatacaaactccatctgtggcaggcagcatgaaccccactgccctgtgtctattacaagagcaattgcccagccacaactacttaccttcccagactcccttgcaagcaggggtggtcacatgacccagtctggccaatgtcatgtaagtgggagtctattgggaaggggacataaatccaggggaagatgaactatcttgcatgcatgagaatgaaggatgctcactaacacaggtggagtagaaggcagggagaaactgggttctggtggcagccctggactgccccctccacaccactgcagtcaaatttcctttacttgcataaattgcaactggtgacagttcttaactgataaaccatcttcaaccaaactacatgttttttgggcaaatggagaagtcaagggagtggctccgacaaagccagcaaagcccacctccccagagtgagagatacgccaagaaggagaacctactctccactctttgcatcagtgggaatgtgtacaggggctaagggtgagagattccgtggggccatctcctcagcttcacagaacaaagccaggtactctccatcaccgacttttttttctccatagcacacacctctatccagcataccacctattgtacttacttgaataatttattgtttgtcttccccacatagaaagttagctacaagagggttaaggtgattgtgtgttttacacattgctgcattgccagggcctaggacagtaactggcatactgtaggggcttaataatgtttatcaaataaatgaatgaaccaagaatttaaagcccaatgaaccatctttcaaatataaagtcaacagaaaaacatgttgaacatatttttgaattatagttcccatgaccccttcttaaaaaaattaaggacacccttaggcaaatcaagaatgattcagaaaagtttaatgtaaaaggatgggcagatgatttttttaaaagttctgtggatagatggcagtgatggctgctgtattaatccattttcatgctgctgataaagacatacccaagcaatttacaaaagaaagaggcttaactggacttacagttccacatggctggggaggcctcacaatcatggtgaaaggcaaggaggagcaagtcacgtcttatgtggatggtggcaggcaaagggacagagagagtgagcgagcttgtgcaggaaaattcccatcagacctcatgaaatttattcactatcatgaaaacagcatgggaaagacttgcccccatgattcaattacctcccactgggttcctcccatgacacatgggaattgtgggagttacaattcaagatgagctttgggtacagccacagccaaaccatatcagttgccctacagtgagaaggtacttaatgcccctgaactgtatacttaaaaatggttaaaatggttatatgttatgtgcattctaccacaattcataaaaaggatgagcagaagcataacaaatgcaaatgaagagaaatcaggggtcaagttgtaaatggagcactgccaagagtgccagcaatgagcacagaatttgtgtaactgcaggactattaaagccaatctaaagattatgaccatcacagagaagaatgaaacaaaacagaactggcataaataataaaaagtaggaggggtggaggtgagaaggagagaggtaatacaagtaaactatgtcatattcatatatagttggaggtctaaattattgcttagaagtctaagtaaaattagaggcatcaaggtaaacaaaaaataatcaactaaaataacttgatggaagggagacaagaagagggaaagtagaaatattctaattttgatattgttcacagtagggagaaaataagcgctgtctagagaaataaaaggattaaagatatcatgtcatattataattatgaagataaccatgggatcaaaaacgcagctttccaaattatcagaagacatacacacagaaaataaaacaaagacaacagagaccgtatggtgaaaactgacaacccccacaaaactataaaagcagaaagcctatcaaacaatgatgacagaactaagaccaaatgcatctgccatatctgtaaatgttagtgagccatacacacttgcttaaaaaaaaaaa

SEQ ID NO: 12778 - DNA, 4086 bp, Homo sapiens
ggcagccccaactcttccaccacctcctccatctccggctcctgggcttgggaggccccgcgccactgcttcgactggctggggcgggaaggttgaaatggctttgagactccacttttgagcttactcctcctttgcccgactattttctcatagtccctattccaatcaatttctggtgcagcccagcttgaaatggctcttgagcctccgcttttcagctgactcctcgattgctcaactattttctcatagtccctgttccggtcaatttccggcgcagcccagcccagtccggcgaggtctggaaaggcctgactcgcctcgcagcctgaatgacttgtacccaccgccgatgcggacctcccagtcttcttggcgactgtggggtggggggcatgcggttgaagccgttcacacgggcagtccctgcatgtcccctcacgtgctccccagtgcacgcggcacccccgcctccacgcttccctgagcgtgcagcctttggtgagggcagccccacgcacagccccccacaccctccccagcgcctgcagcccctggtgcacgcagtccccaagcccgcacgtgcagcccccaccttgcacacagctccatgtacagcccctcatacgttcacagccccagtggcgcagaacccatcactactcgctcttcacgcgcttcactgggcgtgcagcccccacagcgcgcagctcaatgcagcctctccacgtgctccccagggcctgcagcctcgtcttaacttcttttgccaggcccacacatacctgcctatggcctgagtggattggcaatgacagtggtgacagctgacatttactgagtacatgctatgttccagatgctgcgtttccattctccaatgaagaatcttaagtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaagatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgcactggagctggagaatttgcttctagggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggcaaagaaaaaagaaaggaggaaggggtgttggagcagattgtagttgatccacagcaaagagcatcaccaaagccattccaggaggaactagatccaccacttcctctgctgggcatgctccaaaaatggttgtggcctccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgactccaagcacatccaggaatgcacttactgataagatattgaggcaagctgtaccagcagctcctggggacgtgctcagtggatggtacccaagcccctgcatttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaattagt

SEQ ID NO: 12779 - DNA, 4289 bp, Homo sapiens; identical to SEQ ID NO: 12768

SEQ ID NO: 12780 - DNA, 3676 bp, Homo sapiens; identical to SEQ ID NO: 12769

SEQ ID NO: 12781 - DNA, 3556 bp, Homo sapiens; identical to SEQ ID NO: 12770

SEQ ID NO: 12782 - DNA, 3408 bp, Homo sapiens; identical to SEQ ID NO: 12771

SEQ ID NO: 12783 - DNA, 3622 bp, Homo sapiens; identical to SEQ ID NO: 12772

SEQ ID NO: 12784 - DNA, 3586 bp, Homo sapiens; identical to SEQ ID NO: 12773

SEQ ID NO: 12785 - DNA, 4070 bp, Homo sapiens; identical to SEQ ID NO: 12774

SEQ ID NO: 12786 - DNA, 3768 bp, Homo sapiens; identical to SEQ ID NO: 12775

SEQ ID NO: 12787 - DNA, 3656 bp, Homo sapiens; identical to SEQ ID NO: 12776

SEQ ID NO: 12788 - DNA, 2281 bp, Homo sapiens
agcattgacatcttagtatccagtgtagaagcatcaacgtcttggtgtccagtgtagacagcatcaacaccttggtatgcagtgtagacaccatccatatgttggtatccagtgtagacagtatcaaagtcttggtatctagtgtggacagcatcgatgtcttgttgtccagtgtagacagcattgacatcttggtgtccagtgtagacagcatcaacatcttggtatacagtgtagacagcatccatgtcttgacatccagtgtagacagcattgacctcttggtatccaatgtagacagcatccatgtcttagtatccaatgtagacagcatcaaagtcttggtatctagtatagacagcataaacttcttggtatccagtgtagacagcatccatgtcttggtatccagtgtagacagtatcaaagtcttggtatctaatgtagacagcatcgatgtcttagtatccagtgtagacagcattgacgtcttggtgtccagtgtagacagcattaacatcttggtatgcaatgtagacagcatccatgtcttggtatccagtgtagacagtatcaaagtcttggtatctagtgtggacagtatcgacgtcttggtgtccagtgtagacaccatcaagatcttggtatccagtgtagacagctccatgtcttggtatccagtgtagtggcattaatggctcatatgtgtgctcagccaatccttcctcggctgattcttcactcctttcagaccgggctcacagatgtagcatcaaatgttgacactgcccccaccccccattccacaggaatccctacctcgttgactttgcttttctgttctccatgtaacttctctccccttggcacatcccacacatgtctcccctcactggaataggagctacctgaagaaagagagtcccccttttctgtttactgttgaattccaggcatgagatcaaagcccaccatggggtaggtgttcaataaatatgtattgctttaacaaaaaaggcattctgatacataatctatccgttgaacatagcacttcaccttagcttttaacaatattataagtgcatccacccgatacgcccacccaccccagcagcacaaaaataaatggatcaaaacaagcaatagaacaggagccaggcccggtggccacatctgtaatcccagcattttaggaggccaaggcttgagcccaggagttcaagaccagcctggcccatgtggcaaaaccccatctctacgaaataatttaaaaaattagccggacatggtagcatgcacctatagtcccagctactcaggaggctgaggtggtaggatcactcgagccagaaggttgaggctgcagtgagccatgatcattccagtgcactccagcctgggtgacagcgtcaagaaagaaagagagagagacagagagagctttggaattgagagttccatctataatggtatttgatgattactggttttgtggcaaaagctttcagtgttctagcctggctttgggctagattccagtgaagaagggactgtagggggtgggggagtcattagtctgagattcacagtaattacgataattacaatagaatcacaaaggactctaaggtgtcattgattctatccttcatctccaaggtctccagatagatgtatgcatatgaaattcaaccaagaaatgattcccacagttagtttaagacacctttcaaattttagctttggtttgaaaataatcattcggcaatgggtgtcctcagtggttgaaaacaacagccagaaatcacttctggtgcctgcacagtggctcacccttgtcatcccaacactttgggatgctgaggagggaggattgcttgagctcaggagttcgagacaagcctgggcaacatagtgagaccccaactctaaagaaatgtcaaaaaatttgctgaatatcatggcacgcagctgtcattccagctactcatgaagctgagacaggagaatcacttaagcccaggagctcaaggctgcagtgagccgagattgtgccactgcactccagcctgggcaacagagcgagatcttgttgaaagaaagaaagaaaaagaaagaaagaaaaagaaagagaaagaaagaaagaaagaaagaaagaaagaaagaaagaaagaaagaaagaaagagagaaagaaagaaaagagagagagagagaaagagaaagaaagaaagagtgagagagagagaagagagagaaaagaaagaaagagaaaaaaga

SEQ ID NO: 12789 - DNA, 1149 bp, Homo sapiens
atgccccgggcgtcctccccaggcgggagcgggcggagcgggaggggtgggcgtgaggacccgagccgccgccaccgccgcagcccggggattccgatcgcgcccggccgccggcgggagaggaccccgaggaccgagaacccagcgccggcccgccactccccgccgcttaattaccttcgcctccgcccccggggggagcctcctgcaagtcgccccctctcggagcccgcacccagagggggaattccttcccccgcaggacgattttctggttcccggggatcagaaccagcggccaggcggttctatgccgcttggcaccgctttcattttatttcagatgaagacgttgagcttagtcagaaggggcataaatcaggacaattagcattggcgccaagaagatcctctaataccaatttcgcccgggtttccttcgcgcattcctccactcaagtcagaaatgtcactgcacatagcactgatggcagtgagacgcgacgcacccaaagtccgtttgatgaaatatacatggcccacgacgcttctggattgcggctcccggactccccgcccccaccagcggctcccggccgggaccctgctccgagcgggcagcgagctcctggcaaacttaggggccagtgccaattaaagagtgagcgcgagagccggaaagaggagcggcaaagaagcaagcccggggaagccgcagccctcggaggggtggcatcaagtggaaggatagcaaaccttatactacctcgagacctgtgcgctccgagcggtcctaactccgtcccgctcgctgttgctgttgctggtgctgctccggctgcagctgctgccgctccacgacctcggggcgctgaggcaacagggccccctccctctactccccatcccccccggctcctccacagaagcgccgtttccagtaactcctcgtgtacctcccacttctgccgccgtccatcccacccctctctcttctgtcccctccccaaaccgttcccaagcacacccttcgccgctggaagtgatcacaatgttgtttttcaacaagcacttcctttgcccggaggcccctacagccctagactggaacctcctcctttagaaattcattcccctttaaaaagttga

SEQ ID NO: 12790 - DNA, 4086 bp, Homo sapiens
ggcagccccaactcttccaccacctcctccatctccggctcctgggcttgggaggccccgcgccactgcttcgactggctggggcgggaaggttgaaatggctttgagactccacttttgagcttactcctcctttgcccgactattttctcatagtccctattccaatcaatttctggtgcagcccagcttgaaatggctcttgagcctccgcttttcagctgactcctcgattgctcaactattttctcatagtccctgttccggtcaatttccggcgcagcccagcccagtccggcgaggtctggaaaggcctgactcgcctcgcagcctgaatgacttgtacccaccgccgatgcggacctcccagtcttcttggcgactgtggggtggggggcatgcggttgaagccgttcacacgggcagtccctgcatgtcccctcacgtgctccccagtgcacgcggcacccccgcctccacgcttccctgagcgtgcagcctttggtgagggcagccccacgcacagccccccacaccctccccagcgcctgcagcccctggtgcacgcagtccccaagcccgcacgtgcagcccccaccttgcacacagctccatgtacagcccctcatacgttcacagccccagtggcgcagaacccatcactactcgctcttcacgcgcttcactgggcgtgcagcccccacagcgcgcagctcaatgcagcctctccacgtgctccccagggcctgcagcctcgtcttaacttcttttgccaggcccacacatacctgcctatggcctgagtggattggcaatgacagtggtgacagctgacatttactgagtacatgctatgttccagatgctgcgtttccattctccaatgaagaatcttaagtctcagggcctcatgcaaaactatacagctaataaacagtagagttgggatctaagcccagggaattttactctagaactcgcagtattaaccacagtgctctcttggcttatatttctaaggcacatgctgtaaccacttttttttttttttttttgagatggggtctcactctgacatccaagctggggtgcagtggcgcgatctcggcacactgcaaccttcgcctcccagattcaagggattctcctgcctcaggctcctgagtagctaggattacaggcacatgccaccatgcccgtataattttttgtatttttagtagagacggggtttcgccatgttgcccaggctggtctcaaacacctgacctcaggtgatccgcccatctcggcctcccaaagtgctgggattacaggtgtaagccgccacgccctgcctataaccattctttttttagggaggtgtggtatatggtgctaccctggatctgtagtcaggatttgaagaagggagaaggtatttgcttgtgaagaaggcaccatgcattgtgctctgtagtggtgactggagagagagctgggaggggcacaggcagcaaggtccctgcttaaagacagttatctagtttggagaaacttagctggatagtcagttcttacatgcatttggcaagcacttatcatacactgtaaagaggcaatatgtctagcttgttagagggtgggctctggagtcagacttctggctttgaaccccaacttccctgccattttcaaatgacactggagaagtcacaaaacctatttctgtctcagattcctccccagtaaaagtgggatattaatagtacctcctttggcttgatatgaaaattcaatgagttgatatatgcagaacatcttagaacagcaactagcttagagtaaatcttcagtaattgtaaactgtgaatatactatgtttttggcactgaagccacgtcgtggtaagacagtgcctgacctcaagaagctcagagtctagtactggagacaggtgaacaaatacttgcaaagtgtgtggtgtgagagaggtgtgacaggtgggcgggagcctgcagcaggcacatctgacccatcctaggtgtgtgttgtgcagaaaagttagcctaggctttctaggggcactgatgtctgggccgagtcttgtagggcagggaattagtcaaggggagctgtagtgatccagctggggctgagcaggagctgaaagtgaacagctcacatctgtagggttgccagatttagcaacggaaagtacaggatgccctattaaatgtgaatttcagataaaataataactttgaagaatatgtgtcatgcaatatttttagtataagtatgtcccaaatattgtataaccacacacattattcattgtttatctgaaattcaaatttcactgggcatcctatgaaaagtctgtcaattttatctgtccgcatttaggaaggtgcagtatgtttcagagtagctggagtgatgcagggaggaaaggcagagtgggccggatggggctgagaggcacacaggaggcagtttgtaaaaaacctatgctatgttaagggatttagattttatcctgaaattagtgatgagcccttggagagctttaaccacagggatgtgaaaccacagagacagcagtgtcgggcacgaagaaatgagtgtcactttctatggctgaatagcaaattactccaaatttaaagtcttaaacagtaaacattatctcccagtttctgtggctcaggaattcagaggcaacttagctgggtggttctggctgaggtttctcatgaggttgtagataagatagtgaccagagtggcagttatctaaaggatgtactggagctggagaatttgcttctagggtgactcactctaatggttgggaaggtactgctggctgtcagcaggagagctcagttccttgctacaggaccccccataggacaacttgagcctcctcacaacatgacagctggcttagtaatccaagacagcaaagtgacattaactttggaagtcacatgccaccttgtcattcccatatatcccagtgctaacacagctcagccctgctcagtgcaggagggtcctacacaaggatgtacatacaagaaggtggggatcatggggttatcttggaggctggttttctgggatgggaggcttacatggtgatgcctgtgaccttggaggtggaggagaatgatgggcgtacagaggagtgaagaaaggctgggaggaatagagatgtgggagaggaggtgaggcaaagaaaaaagaaaggaggaaggggtgttggagcagattgtagttgatccacagcaaagagcatcaccaaagccattccaggaggaactagatccaccacttcctctgctgggcatgctccaaaaatggttgtggcctccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatccccctcccttaagggaataactagtgcaagctgactccaagcacatccaggaatgcacttactgataagatattgaggcaagctgtaccagcagctcctggggacgtgctcagtggatggtacccaagcccctgcatttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcactggcaataaaagaactcctgaattagt

SEQ ID NO: 12791 - DNA, 2709 bp, Homo sapiens; identical to SEQ ID NO: 12777

SEQ ID NO: 12792 - DNA, 4658 bp, Homo sapiens
gtgaatttccgtttccggtggtgtccaatccgacctgaggagtcacagttgtgagcaaattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggttgccaagctgttctgcctttctggaatggtgcatggagaatatcaaaaccaagaaatgcacaatctgggccattttattacagttatgaagtttaggcctctcacatggcagacttctcatccttatatcctggcagacaggtaaaaaggtggaagatttgacaaacccagaggatatccaaacaaacatcagatgtgaccagcagatgttactttacggttatttaagaggagcgcacttgaaaaataaaagccaaattcacatgccaggacgaggtggggcccacccatgagctggtccagagtctcatctccacccactccaccattgatgccaagatggcttcaagtcgagtgatgttgttttctgattccaagccacttgggtcagaggctatagataatcaagggtgagtggtgtcattgagcaaacacgaagtcgggctcatccaaggatgagattttgccagagaaaggacgagcagcaagtcagggagcttaaggtaattatgggaaagtgactatctacaattgcttaggtagaaggagacagattggatttttgtgtgtttggtatttgggataagagggatgtgggtgtgtacttgacatgggttgttctctctctctcttttttttttttttttttttgagagggagtctcactctgtcacccaggctggagttctgtggcacagtcttggctcactgcaacctccgcctgccgggttcaagggattctcctgcctcagcctcccaagtagctggggttacaggtgcctgccaccacgccctgctaatttttgtgattttttttttagtagagacgaggtttcactatgtaggcaaagctggtctcgaactcctgacctcagatgatccacccgcctcagcctcccaaagtgctgggattacaggcgtgagccaccgcacctggcctgtttattctcttaagagagaaaatgaggggattaatggactgtagttctggacaaggtggaaaactcttaaagtggaagtattggggcaagtgctctgacaggctaggatggtgcagtcagtcccttcacccagaaatcagtagaatgttaacagttcagactcaaaccttgtgaaaaacaggtggtggaaaggaaatccctcacagcaactggcaccataatcaagacagaatgtttgcagaataaatggagttacctgctttcagccccaggttgtagctattgtctgccctgatgatatgtgataataatttgtgatcctattgtcttaaaatggggtcactcatctccagtagaattaagtccacagtgaagttgtccccccatccccaaagagataaacatatatgaatgaactcacatgataacaactactgctgcctgggatcatgagagacctgaactgaactgataggaagtgaaaggtggctgagataatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactcctgtgtgtagaatgataattgcacaattgatagtgtgaacacctcttgataaatggtaaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtcaaaacaatggaagactgtagaagatgctattcattaagatatctcaagaatgtggaagactattattcgcttctcatgggacaggactttatagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtatgtttttcatatatgcttgcaaagggttgtaaaactttattgtgattattcttgctttaagctgaaacttccctaatctttctttagagattgtggcatagcatgttagtttcttttccatatccaattgttttctgtaatgaatacagaaatatgggcactattttgtaactttaaatagacatcatctcaagtctacaagaattatccaaaatggtatttaatgacatttctaggtcttcagacactattaatgtagattgtagcctctaggtcctgaggatttttactggatactggttactgaaactgagctttcttgaattctttttccttccactgtggtttcccgcatttcaacacatcacctatttttgtcctcaaacgttacttaaattttttccacagaattaaattaaatatgaatcatccctcctctgatttttgaaatgaccctttgcttcctatgataatgattcttctggtccgttttgtagttatatgttagagtttgtaaatattcacacattttgcaactgcatataattttctcattttttcctcttcctctaaagctgctgttatttcttttaactttttgtgggaaaaattaaacccatctttcactttgttgatatttataattgaactccttgatttttgcttgaattgcttttcaagttacccacttttagggaagacattatttgggttttgtttagtgtatcaggctttttttagttagttgtatcaagaagtgtagacttttctatacataatatcctttttcccacagtagtttttttttttttaaagtctagccgggtgcagtggctcacgcctgtaatcccagactttgggaggccgaggtgggcagatcacgaagtcaagagaccgagaacatcctggctaacacagtgaaaccccgtctctactaaaaatacaaaaaattagccggacatggtaacgggtgcctgtagtcccagctaatcaggaggctgaggcaggagaatgacatgaactcaggaggcagaggttgcagtgagccgagatcgtgccactgcactccagcctgggtgacagagcaagactccatctcaaaaaaaaaaaaaaaaaaaaagtctgttaaaataaaggtcatcaaaagatcttttcctaaacctttcctttaccagaaatatctctagagtcacatggtcctttctcccttcttgcttttgtaggagtccaaagctaatctgtccctgatccggattgcatgcacctgtgccttttggggcccttctgcattagttcttccttctcttctaacctcaaaaatgtgttttctctgttggctctttccctttaacatagaagtatactcacgcttttgttgaatcttggaataaaagtcttcctttaccacatatctccctttaatactacatctctcttctcagccaaatacttgggaagacaagccctgagtttgtgtgattgttttctcacctccagttcactactttgaacaggcactgtgctaggtgctgctgttatagatatgaaaagaaggcatcatctcctttctaacaactcataggagcagccattcctgattcatacgcaggtctcttgattctcagtgctcacttttgcaagcttcacttaatgccgtgtaaatcaccctattctccaggtcttctttcttcccag

SEQ ID NO: 12793 - DNA, 4221 bp, Homo sapiens
aggagtcacagttgtgagcaagttcggtgccgcgggctggggtaggcggcagtggggtccctggctttggggcactgggaagatcgcgagtgggaaggtcctcccgcggtcctccgggtcatctttcctcctgaggagcagcatatttcgcatctgccggagattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggttgccaagctgttctgcctttctggaatggtgcatggagaatatcaaaaccaagaaatgcacaatctgggccattttattacagttatgaagtttaggcctctcacatggcagacttctcatccttatatcctggcagacaggtaaaaaggtggaagatttgacaaacccagaggatatccaaacaaacatcagatgtgaccagcagatgttactttacggttatttaagaggagcgcacttgaaaaataaaagccaaattcacatgccaggacgaggtggggcccacccatgagctggtccagagtctcatctccacccactccaccattgatgccaagatggcttcaagtcgagtgatgttgttttctgattccaagccacttgggtcagaggctatagataatcaagggtgagtggtgtcattgagcaaacacgaagtcgggctcatccaaggatgagattttgccagagaaaggacgagcagcaagtcagggagcttaaggtaattatgggaaagtgactatctacaattgcttaggtagaaggagacagattggatttttgtgtgtttggtatttgggataagagggatgtgggtgtgtacttgacatgggttgttctctctctctcttttttttttttttttttttgagagggagtctcactctgtcacccaggctggagttctgtggcacagtcttggctcactgcaacctccgcctgccgggttcaagggattctcctgcctcagcctcccaagtagctggggttacaggtgcctgccaccacgccctgctaatttttgtgattttttttttagtagagacgaggtttcactatgtaggcaaagctggtctcgaactcctgacctcagatgatccacccgcctcagcctcccaaagtgctgggattacaggcgtgagccaccgcacctggcctgtttattctcttaagagagaaaatgaggggattaatggactgtagttctggacaaggtggaaaactcttaaagtggaagtattggggcaagtgctctgacaggctaggatggtgcagtcagtcccttcacccagaaatcagtagaatgttaacagttcagactcaaaccttgtgaaaaacaggtggtggaaaggaaatccctcacagcaactggcaccataatcaagacagaatgtttgcagaataaatggagttacctgctttcagccccaggttgtagctattgtctgccctgatgatatgtgataataatttgtgatcctattgtcttaaaatggggtcactcatctccagtagaattaagtccacagtgaagttgtccccccatccccaaagagataaacatatatgaatgaactcacatgataacaactactgctgcctgggatcatgagagacctgaactgaactgataggaagtgaaaggtggctgagataatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactcctgtgtgtagaatgataattgcacaattgatagtgtgaacacctcttgataaatggtaaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtcaaaacaatggaagactgtagaagatgctattcattaagatatctcaagaatgtggaagactattattcgcttctcatgggacaggactttatagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtatgtttttcatatatgcttgcaaagggttgtaaaactttattgtgattattcttgctttaagctgaaacttccctaatctttctttagagattgtggcatagcatgttagtttcttttccatatccaattgttttctgtaatgaatacagaaatatgggcactattttgtaactttaaatagacatcatctcaagtctacaagaattatccaaaatggtatttaatgacatttctaggtcttcagacactattaatgtagattgtagcctctaggtcctgaggatttttactggatactggttactgaaactgagctttcttgaattctttttccttccactgtggtttcccgcatttcaacacatcacctatttttgtcctcaaacgttacttaaattttttccacagaattaaattaaatatgaatcatccctcctctgatttttgaaatgaccctttgcttcctatgataatgattcttctggtccgttttgtagttatatgttagagtttgtaaatattcacacattttgcaactgcatataattttctcattttttcctcttcctctaaagctgctgttatttcttttaactttttgtgggaaaaattaaacccatctttcactttgttgatatttataattgaactccttgatttttgcttgaattgcttttcaagttacccacttttagggaagacattatttgggttttgtttagtgtatcaggctttttttagttagttgtatcaagaagtgtagacttttctatacataatatcctttttcccacagtagtttttttttttttaaagtctagccgggtgcagtggctcacgcctgtaatcccagactttgggaggccgaggtgggcagatcacgaagtcaagagaccgagaacatcctggctaacacagtgaaaccccgtctctactaaaaatacaaaaaattagccggacatggtaacgggtgcctgtagtcccagctaatcaggaggctgaggcaggagaatgacatgaactcaggaggcagaggttgcagtgagccgagatcgtgccactgcactccagcctgggtgacagagcaagactccatctcaaaaaaaaaaaaaaaaaaaaagtctgttaaaataaaggtcatcaaaagatctttt

SEQ ID NO: 12794 - DNA, 4120 bp, Homo sapiens
gtggtgtccaatccgacctgaggagtcacagttgtgagcaagttcggtgccgcgggctgggattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggttgccaagctgttctgcctttctggaatggtgcatggagaatatcaaaaccaagaaatgcacaatctgggccattttattacagttatgaagtttaggcctctcacatggcagacttctcatccttatatcctggcagacaggtaaaaaggtggaagatttgacaaacccagaggatatccaaacaaacatcagatgtgaccagcagatgttactttacggttatttaagaggagcgcacttgaaaaataaaagccaaattcacatgccaggacgaggtggggcccacccatgagctggtccagagtctcatctccacccactccaccattgatgccaagatggcttcaagtcgagtgatgttgttttctgattccaagccacttgggtcagaggctatagataatcaagggtgagtggtgtcattgagcaaacacgaagtcgggctcatccaaggatgagattttgccagagaaaggacgagcagcaagtcagggagcttaaggtaattatgggaaagtgactatctacaattgcttaggtagaaggagacagattggatttttgtgtgtttggtatttgggataagagggatgtgggtgtgtacttgacatgggttgttctctctctctcttttttttttttttttttttgagagggagtctcactctgtcacccaggctggagttctgtggcacagtcttggctcactgcaacctccgcctgccgggttcaagggattctcctgcctcagcctcccaagtagctggggttacaggtgcctgccaccacgccctgctaatttttgtgattttttttttagtagagacgaggtttcactatgtaggcaaagctggtctcgaactcctgacctcagatgatccacccgcctcagcctcccaaagtgctgggattacaggcgtgagccaccgcacctggcctgtttattctcttaagagagaaaatgaggggattaatggactgtagttctggacaaggtggaaaactcttaaagtggaagtattggggcaagtgctctgacaggctaggatggtgcagtcagtcccttcacccagaaatcagtagaatgttaacagttcagactcaaaccttgtgaaaaacaggtggtggaaaggaaatccctcacagcaactggcaccataatcaagacagaatgtttgcagaataaatggagttacctgctttcagccccaggttgtagctattgtctgccctgatgatatgtgataataatttgtgatcctattgtcttaaaatggggtcactcatctccagtagaattaagtccacagtgaagttgtccccccatccccaaagagataaacatatatgaatgaactcacatgataacaactactgctgcctgggatcatgagagacctgaactgaactgataggaagtgaaaggtggctgagataatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactcctgtgtgtagaatgataattgcacaattgatagtgtgaacacctcttgataaatggtaaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtcaaaacaatggaagactgtagaagatgctattcattaagatatctcaagaatgtggaagactattattcgcttctcatgggacaggactttatagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtatgtttttcatatatgcttgcaaagggttgtaaaactttattgtgattattcttgctttaagctgaaacttccctaatctttctttagagattgtggcatagcatgttagtttcttttccatatccaattgttttctgtaatgaatacagaaatatgggcactattttgtaactttaaatagacatcatctcaagtctacaagaattatccaaaatggtatttaatgacatttctaggtcttcagacactattaatgtagattgtagcctctaggtcctgaggatttttactggatactggttactgaaactgagctttcttgaattctttttccttccactgtggtttcccgcatttcaacacatcacctatttttgtcctcaaacgttacttaaattttttccacagaattaaattaaatatgaatcatccctcctctgatttttgaaatgaccctttgcttcctatgataatgattcttctggtccgttttgtagttatatgttagagtttgtaaatattcacacattttgcaactgcatataattttctcattttttcctcttcctctaaagctgctgttatttcttttaactttttgtgggaaaaattaaacccatctttcactttgttgatatttataattgaactccttgatttttgcttgaattgcttttcaagttacccacttttagggaagacattatttgggttttgtttagtgtatcaggctttttttagttagttgtatcaagaagtgtagacttttctatacataatatcctttttcccacagtagtttttttttttttaaagtctagccgggtgcagtggctcacgcctgtaatcccagactttgggaggccgaggtgggcagatcacgaagtcaagagaccgagaacatcctggctaacacagtgaaaccccgtctctactaaaaatacaaaaaattagccggacatggtaacgggtgcctgtagtcccagctaatcaggaggctgaggcaggagaatgacatgaactcaggaggcagaggttgcagtgagccgagatcgtgccactgcactccagcctgggtgacagagcaagactccatctcaaaaaaaaaaaaaaaaaaaaagtctgttaaaataaaggtcatcaaaagatctttt

SEQ ID NO: 12795 - DNA, 4657 bp, Homo sapiens
gtgaatttccgtttccggtggtgtccaatccgacctgaggagtcacagttgtgagcagattagaattacttgttattggtaaatagccactatggagactaaggaccagaagaaacaaagaaagaaaaatagtggacccaaagctgcaaagaaaaagaagcggcatctgcaggatctccagctaggagacgaagaagatgcctggaagagaaatcccaaagcttttgcatttcagtctgctgtgtggatggctcgatcctttcacaggactcaggatttgaagacaaaaaagcatcatattccagtggttgatcgaactccactagagcccccaccaatagtggtagtggtgatggggcctccaaagttggaaagagcactttgatacaatgcctcattcggaacttcacccggcagaagttgaccgagatcagaggccctgtgatgatcgtgtcaggtaaaaagctccgactcaccattattgaatgtgggtgtgacattaacatgatgattgatctggctgaagtagcagatctggtactgatgcttatagatgccagctttgggtttgaaatggaaacgtttgagtttctaaacatctgtcaagtacatggctttcctaaaattatgggagttctcacccacctcgacttcttcaaacacaataagcaactgaagaagacaaagaagcgattaaaacacaggttctggacagaagtttacctggttgccaagctgttctgcctttctggaatggtgcatggagaatatcaaaaccaagaaatgcacaatctgggccattttattacagttatgaagtttaggcctctcacatggcagacttctcatccttatatcctggcagacaggtaaaaaggtggaagatttgacaaacccagaggatatccaaacaaacatcagatgtgaccagcagatgttactttacggttatttaagaggagcgcacttgaaaaataaaagccaaattcacatgccaggacgaggtggggcccacccatgagctggtccagagtctcatctccacccactccaccattgatgccaagatggcttcaagtcgagtgatgttgttttctgattccaagccacttgggtcagaggctatagataatcaagggtgagtggtgtcattgagcaaacacgaagtcgggctcatccaaggatgagattttgccagagaaaggacgagcagcaagtcagggagcttaaggtaattatgggaaagtgactatctacaattgcttaggtagaaggagacagattggatttttgtgtgtttggtatttgggataagagggatgtgggtgtgtacttgacatgggttgttctctctctctctttttttttttttttttttgagagggagtctcactctgtcacccaggctggagttctgtggcacagtcttggctcactgcaacctccgcctgccgggttcaagggattctcctgcctcagcctcccaagtagctggggttacaggtgcctgccaccacgccctgctaatttttgtgattttttttttagtagagacgaggtttcactatgtaggcaaagctggtctcgaactcctgacctcagatgatccacccgcctcagcctcccaaagtgctgggattacaggcgtgagccaccgcacctggcctgtttattctcttaagagagaaaatgaggggattaatggactgtagttctggacaaggtggaaaactcttaaagtggaagtattggggcaagtgctctgacaggctaggatggtgcagtcagtcccttcacccagaaatcagtagaatgttaacagttcagactcaaaccttgtgaaaaacaggtggtggaaaggaaatccctcacagcaactggcaccataatcaagacagaatgtttgcagaataaatggagttacctgctttcagccccaggttgtagctattgtctgccctgatgatatgtgataataatttgtgatcctattgtcttaaaatggggtcactcatctccagtagaattaagtccacagtgaagttgtccccccatccccaaagagataaacatatatgaatgaactcacatgataacaactactgctgcctgggatcatgagagacctgaactgaactgataggaagtgaaaggtggctgagataatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactgcctgtgtgtagaatgataattgcacaattgatagtgtgaagacctcttgataaatggtgaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtcaaaacaatggaagactgtagaagatgctattcattaagatatctcaagaatgtggaagactattattcgcttctcatgggacaggactttatagggcacctgaaaaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtatgtttttcatatatgcttgcaaagggttgtaaaactttattgtgattattcttgctttaagctgaaacttccctaatctttctttagagattgtggcatagcatgttagtttcttttccatatccaattgttttctgtaatgaatacagaaatatgggcactattttgtaactttaaatagacatcatctcaagtctacaagaattatccaaaacggtatttaatgacatttctaggtcttcagacactattaatgtagattgtagcctctaggtcctgaggatttttactggatactggttactgaaactgagctttcttgaattctttttccttccactgtggtttcccgcatttcaacacatcacctatttttgtcctcaaacgttacttaaattttttccacagaattaaattaaatatgaatcatccctcctctgatttttgaaatgaccctttgcttcctatgataatgattcttctggtccgttttgtagttatatgttagagtttgtaaatattcacacattttgcaactgcatataattttctcattttttcctcttcctctaaagctgctgttatttcttttaactttttgtgggaaaaattaaacccatctttcactttgttgatatttataattgaactccttgatttttgcttgaattgcttttcaagttacccacttttagggaagacattatttgggttttgtttagtgtatcaggctttttttagttagttgtatcaagaagtgtagacttttctatacataatatcctttttcccacagtagttttttttttttaaagtctagccgggtgcagtggctcacgcctgtaatcccagactttgggaggccgaggtgggcagatcacgaagtcaagagaccgagaacatcctggctaacacagtgaaaccccgtctctactaaaaatacaaaaaattagccggacatggtaacgggtgcctgtagtcccagctaatcaggaggctgaggcaggagaatgacatgaacccaggaggcagaggttgcagtgagccgagatcgtgccactgcactccagcctgggtgacagagcaagactccatctcaaaaaaaaaaaaaaaaaaaaagtctgttaaaataaaggtcatcaaaagatcttttcctaaacctttcctttaccagaaatatctctagagtcacatggtcctttctcccttcttgcttttgtaggagtccaaagctaatctgtccctgatccggattgcatgcacctgtgccttttggggcccttctgcattagttcttccttctcttctaacctcaaaaatgtgttttctctgttggctctttccctttaacatagaagtatactcacgcttttgttgaatcttggaataaaagtcttcctttaccacatatctccctttaatactacatctctcttctcagccaaatacttgggaagacaagccctgagtttgtgtgattgttttctcacctccagttcactactttgaacaggcactgtgctaggtgctgctgttatagatatgaaaagaaggcatcatctcctttctaacaactcataggagcagccattcctgattcatacgcaggtctcttgattctcagtgctcacttttgcaagcttcacttaatgccgtgtaaatcaccctattctccaggtcttctttcttcccag

SEQ ID NO: 12796 - DNA, 9416 bp, Homo sapiens
aagcgcgccgcctccccgccctctctcactccccgctcctctccgccgcgcactctcgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgga

SEQ ID NO: 12797 - DNA, 9161 bp, Homo sapiens
ctgaaaactggagagtgtgagagcgggaggagcccccgaccacacaaacccagcctggggaggaacctactagtggctgcaccctcttttttaatagcaccaattgtgtttcccaagatgatgtagagaatttcagtgctgtgtaccacgtcggaggcagaaattcctctgctgtcccaggagcaggcagggcagtttttatctggaaaagctaaaggtctcctcttttgtttgtgtttttgtgcctgcacaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccagtaaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctgga

SEQ ID NO: 12798 - DNA, 2975 bp, Homo sapiens
gaattttctgcaaggatcatatctaagtgcactttttgctgatacttcatttctagacattgagtctcactctaccccccaggctgaagtgcagtggtgtgatctcggttcactgcaacctccgcctccaggttcaagtgattctcgtacctcagcctcccgagtagctgggattacaggcgcctgccaccatgcctggctgatatttatatttttagtagagatggagtttcaccatgttggccaggctggtctcgaactctggacctcagatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacaggtcacttttacaaagagaaagtttggattaatgaagaaagcctatgaacttagtgtgctctgtgactgtgaaatagcactcatcattttcaacagctctaacaaactgtttcaatatgctagcactgatatggacaaagttcttctcaagtatacagaatataatgaacctcatgaaagcagaaccaactcggatattgttgaggctctgaacaagaaggaacacagagggtgcgacagcccagaccctgatacttcatatgtgctaactccacatacagaagaaaaatataaaaaaattaatgaggaatttgataatatgatgcggaatcataaaatcgcacctggtctgccacctcagaacttttcaatgtctgtcacagttccagtgaccagccccaatgctttgtcctacactaacccagggagttcactggtgtccccatctttggcagccagctcaacgttaacagattcaagcatgctctctccacctcaaaccacattacatagaaatgtgtctcctggagctcctcagagaccaccaagtactggcaatgcaggtgggatgttgagcactacagacctcacagtgccaaatggagctggaagcagtccagtggggaatggatttgtaaactcaagagcttctccaaatttgattggagctactggtgcaaatagcttaggcaaagtcatgcctacaaagtctccccctccaccaggtggtggtaatcttggaatgaacagtaggaaaccagatcttcgagttgtcatccccccttcaagcaagggcatgatgcctccactatcggaggaagaggaattggagttgaacacccaaaggatcagtagttctcaagccactcaacctcttgctaccccagtcgtgtctgtgacaaccccaagcttgcctccgcaaggacttgtgtactcagcaatgccgactgcctacaacactgattattcactgaccagcgctgacctgtcagcccttcaaggcttcaactcgccaggaatgctgtcgctgggacaggtgtcggcctggcagcagcaccacctaggacaagcagccctcagctctcttgttgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaagctgatgtttgtacttttgtgttactgcagtgacctgccctacatatctaaatcggtaaataaggacatgagttaaatatatttatatgtacatacatatatatatccctttacatatatatgtatgtgggtgtgagtgtgtgtgtatgtgtgggtgtgtgttacatacacagaatcaggcacttacctgcaaactccttgtaggtctgcagatgtgtgtcccatggcagacaaagcaccctgtaggcacagacaagtctggcacttccttggactacttgtttcgtaaagataaccagtttttgcagagaaacgtgtacccatatataattctcccacactagcttgcagaaacctagagggccccctacttgttttatttaactgtgcagtgactgtagttacttaagagaaaatgctttgtagaacagagcagtagaaaagcaggaaccaagaaagcaatactgtacataaaatgtcatttatattttccaacctggcatgggtgtctgttgcaaaggggtgcatgggaaagggctgttgatattaaaaacaaacaaaacaaaaaagccccacacataactgttttgcacgtgcaaaaatgtattgggtcaagaagtgatctttagctaataaagaaagagaatagaaaacacgcatgagatattcagaaaatactagcctagaaatatagagcattaacaaaggaaaattaatatattaagttataattggaatatgtcagaagtttctttttacattcatatcttaaaaattaaagaaactgattttagctcatgtatattttatatgaaagaaaacacccttatgaattgatgactatatataaaattatattcactacttttgaacacattctgctatgaattatttatataagccaaagctatatgttgtaacttttttttagagaatagctttatcttggtttaactctttagttttattttaagaggggaaaacaaaaatatcttgcaagcagaaccttgaaaaaaaaaaaggaattc

SEQ ID NO: 12799 - DNA, 2670 bp, Homo sapiens
ggccgagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttttgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacagtaaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttaaaaaaaaaaaaaaaaaaaaaaaaaaaaaaaaaaaaaaaaaaaaaaaaaaaaaaaaaaaaaaccaaaaaaaaaaaaaaa

SEQ ID NO: 12800 - DNA, 2237 bp, Homo sapiens
tccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaaaaaaaaaaaaaaaaaaaaaaaaaaaaaaaaaaaaaaaaaaaaaaaaaaaaaaa

SEQ ID NO: 12801 - DNA, 1581 bp, Homo sapiens
ctcgccgctgccccggctccgccgctcgcagagagattcggaggagcccgggcgggggggaggaggagggggaggagggagcggagatctcggggctcggagccggccgccgctccgctccgatcgctgtggggcttggttttttgggggtgggggggcgggggggctcagatatggaggcaaatgggagccaaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccaggcttcccagcagcggcttatggaccagtggcagcagcggcggtggcggcagcaagaggatcaggctccaacccggcgcggcccggaggcttcccgggggccaacagcccaggacctgtcgccgatctctacggccctgccagccaggactccggagtggggaattacataagtgcggccagcccacagccgggctcgggcttcggccacggcatagctggacctttgattgcaacggcctttacaaatggataccattgagcaggtgctttcgttgccatctcactctgagagcatacctggatgtccaggcaagactgggcgaagtttctgagtggccctttgtttaggtgatgtcctcagacctggacccccaccagcctcactccccatcccaaccagagatggctcacttcggatcgagggttgactacatctcatcatctcacgaatctgctgtaatataagacaacagcttttaaatgtgtatataacccatgatttcggttttgttttgttttgtttttcttgatggtttccctctccctccctctcttcccattctccttttaaatctctttgaatcacatttggtagtgattttgacttagtccagtagtcacatagctttaatatctagttcaaagctaaccatagtataattgttatattaaggagttat

SEQ ID NO: 12802 - DNA, 2151 bp, Homo sapiens
gctttccttttagcttttgtaagttacacgtcaaaatggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactagctcttaagagaggcatagcaaagtgggggttgctaccatttctagagagagaggacacagtcccggcctgggctgcccccgctccagtcaatgctcactgaaagtctgtcttagctgcctgtttgaatgactgttctttttctcatttttaattcttggactcatgtcctcattgcttcactcaattaaaaaaaaattattctccagtcccctcccactttgcttcttgtatgcattgtgaccgaccccacttcctcagaatgtaacggggccagagggaaacttctcacaaacttcgtagagcctcctcaggggaagctaggaagaagacatcaaatgtttttaagtcatgaccaaacaggcttgttggggacatatcatggggtgagctttgaagtgctggtggtccagaggggttgcagatacgtgacttggagcacccgtgtcttacgatggacagtgataaaggtgaacacacagagacagactattctctaagaatgtgagaaacctgatctggaagaggagctatataaacactatctgactatctttgtcttttggggccagtggctgttggcataatcacaagcctgtctgtcttcgagaagggacagtggagtcatccaggtgctgccacatgacaggcacggtgggcaccgatccacagtgggccccgccttccccagctcgcctccctgcctgtgctggcctggccttgcctgctggcaccattggagtaggagggggtggaacacagggggcccatcctgatcaggccccatctcaaggttggcactcctgcccatcacccttagaaggatcttttcccatggcttgacttccttcatttccctaactgaaatacacccactctcttggaataatgacgtaccactcagttggaccctcaagagtcactgctttgtctgtgctggtagtttgtgagaagtgacccgcacgcttccatttgatgcatttgatgtgagtgaatccatacatttgaatgtcattgtccttgagaccctacatgtgcagtttggctcatctcattaaagatgcttgatgtaataattggttagtttccttttattttcctgcaggcttttccatgagtattatttttttcaaagaacaaatctgtatggcttttccccatctccatattttgttttgctatgaattgctttgctttggtgaacttgtcctagtatgcttgcctcacaaacgttttagccattgtgaattttcttcatctctgtaaatagttcatctgtgcttctccctgatgacgttttattttttttcccctgtaagcaaccgaggtagaaaaataaattgtttaccatggaaaaaaaaa

SEQ ID NO: 12803 - DNA, 4656 bp, Homo sapiens
tagttaggctttttttaaaagcaaaatttgaaaacggaaatactcttcataagcacagtagagctgttttaatgaaagacaatgataaaaatatgtcaactgaagataccaagaagaactctgatgaaaaaacagatgaggaaaaaatcacctcttttgcctcagctaatgtgtcttcggatcagtggagtttggaggatagacactctttagactcaaacacaccattatttccagaagatagctctgtgggagaattgtctttcaaatcagagaatcaagaggaattctggcatagtaacccttcacatttgagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagagagatgtgaggaggagcttcttcaattactgacacatattttgaattatgtaatgtgtaagggactagaaaagtctgatgatgatacttggattgaacgaggacaagtgttttcagcactaagtaaaccaggaatatccagtgaactacttcgaccatcagatgaaataaaactaactttgctacaaaagatgttagaatgggcaatctcagaaaacagagaagcaaaaactaatccagtaactgctgaaaacgccttccgactagtgctgatcatacaggactttcttcagtcagagggactagttaattcaaacatgtggaccgagaagcttttagaggatatgatgctgctctttgactgtctgtcagtctgctattctgaaagtccagtatgggtaaaactctctcaaattcagatccagttgcttctaggattcattggaaggggtaatttgcaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatatattgtaccttatatgaagcagtatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacgacttagcagtcaacagttagccactcttagacgctggaaagcaatacagctctatcttacatgtgaaaggggaccttgggctaaaaggaaacagaatccaattcactggaagctagctaatgtagagaattattcccgcatgagacttaagctggtaccgaattataatttcaaaacccatgaggaagctagtgccttgagagataatctgggtatccaacactcacagccttccagtgatacattgcttttggaagtagtgaaacaagtaaaagttagtgatatggtggaggataaattagaccttcctgaagaggatataacagctagagtaaatgttgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagaggttagaaacaaaatatatagccgactgttgtcacttcattccccaaatagttattatggaagcagatcaccacaggagttattcaaagcatcaggattgacacagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaaggtttgactgtgcagatcgacagttccattctattcctgctacctggcaagctcttatggataatccatatgatgttaaagaacttattcctgaattcttctatttcccagagtttttggaaaatcaaaatcaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaagataacaataagcatgaattatgttattggaacccatggatggttgccttatgacagaaacatttctaattactttacattcatcaaggatcaaactgtgacaaatccaaaaactcagcgcagtataaatggttcttttgctcccgggctagagatcacttctaagctatttgtagtatcacatgatgcaaagttgctcttcagtgctggatactgggataatagcattcaagtgatgtcacttacaaaaggcaaaattatctcacacatcatccggcatatggatattgtgacttgcttagctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaagtgattgttatttccattttctgttatgattactgaaacctgatttattgctttgtcactttaaccacatctctcaactctctgcaatgttgcaaggcttttatccctgaaaatcatttacagataaccacaatttgctgtggtatataaactaattcttggtctatactaagatgtatttgagaaaatacatttgatttgattttgtggcccattcctaaaggtcattgtatccatttttaaaacaaactaaaatgagaacattaggttcaattttcttattattccaaatgataaaatttaagatttttctaataaaagagtacagataatgggacagttgagagagatggctttaaatacattcttaagtaatcattttcctatttactgaccactgtaatgaaaatatatcaatttatttatggaactcctgattggggataatattttaaaggtatctgttgcacacttggattttcaaaactcggtgaaagttacaagtttgcatggtaagaataaaataagaatattgaaactggtacattagctaattctattactacttagcgtgtttctaatgagaagttactgaaatctattactgtccttaataaaaattgagtagaaaaaagtggaactag

SEQ ID NO: 12804 - DNA, 2013 bp, Homo sapiens
agttccggcatcgcgcctggtggcggagttctgccgagtggggcgccgcggccgctattgtcccgccccctgctccgcaagattcgagcctgagcggcctgggcgtctcgagaggtgagagagttggcggcgaggtctcggcggctaagcgagcgtcggcgactgtctctccgcgagaggaggcaagttggggtccaggctccaaagccggtggccgcgtaccgcggtggagccgctgtctttgaggtctgaggagagaacagacagagtctagctctttcacccaggctggagtgaagtggtgcaatctcagctcagtgcaacctccgccccctgggttcaagtgattctcctgcctcagcctccccagtagctgggattacagtgatatcctgagagaagatgggaaagggctgcaaggttgtggtttgtggattgttatctgtggggaaaactgcaattttggagcagctcctttatggaaatcatactattggaatggaagattgcgaaacaatggaagatgtatacatggcttcagtagaaacagaccgaggagtaaaagaacagttacatctttatgacaccagaggtctacaggaaggcgtggagctgccaaagcattatttttcatttgctgatggcttcgttcttgtgtacagtgtgaataaccttgaatcctttcaaagagtggagcttctgaagaaagaaatcgataagttcaaagacaaaaaagaggtagcaattgtggtattaggaaacaaaatcgacctttctgagcagagacaagtggacgctgaagtggcacagcagtgggcaaaaagtgagaaagtaagactgtgggaggtgactgttacagatcggaaaactctgattgaaccattcactttattagccagtaaactttctcaaccccagagcaaatcaagctttcctttgcctgggaggaaaaacaaagggaactctaattctgagaactaaaaatcagtaatttccacaattgtatgttgaatagtgattgcctttaagtgtctgtgaacatggagtaatattactatttaaaataggccatttgtatctacctttggtccttaggaaaattcctaaggaagtcaattaatgcactttagatgttaaaagtatttgggctaaggttattattgcctgatatgaaataatatattcttattctcattgtttgaaacctgtctttgaaattagcacctttgttatttatgttgtacttgtgaaaacagtaaaatagtttggatagttatgcaaatgcacctatgtgtaacttccccccaaccccaagctgtttcggaagatatcataatcattctgtgtaacattatgcaaacttctaagcccaaacatgactttgtttttaaaaagttcattaatctaatgtctaggattataaaacatttttttgtgtctaaattggacccaaaacattgaacagtttggggtagtaagctaaatttcatcttgtggagattttgctaaacagactaagacccatgatttagctttgctcaaattagaatgtttagcatgagttgaggtaccaggtagtgttaagtaggttcatcacgctctaaggccgttttttccttagccagacccctgttgatagaccagatacttgagggcaaactgtttgctcctcctcttgaaaatgattaggcacttaaggacagtaaagctgtattttctggaaggaagactgtatcttctggaatagttttctagaaaactagtcatatacaataaaagtatcaaaaatattgggctctaatttgatctgacttagatgtctgagtttgtgttgtttctctaaagattttggcaagactcaagcaatgtggctgactgtaactttattaatttaaaaggtaggaagtaagctacttagtggtttcacctgtgaaataactattttgactgaaatgtaaaataagctattcaacaaagaacatattaaaacatcaaaaaaaaaaaaaaaaaaaa

SEQ ID NO: 12805 - DNA, 5895 bp, Homo sapiens
gttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcacttgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctatgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattaaacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaaattcacaagagtaaaatagaaattaatgtgttagaaccagttatgtcacagctatcaaattgccaagataattcttgtcttcaaagtgaaatactacctgtgtctgttgaaagttcacatttaaatgtatctggacaaatagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggaggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcgggaggttcttcatatgcctgtgacagcacctgtatgcaatagaagtatccctcaattccccgcccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcgaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaatactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgttaagaaatttgtatggtgtggcagtggtctattcctaaggaactaaatatcatatagttaatgtttatttaactcagcttgagactgtactacagttaggtttgaataaatattttcattaacttcaaaaaaaaaaaaaaaaaaaaaaaaaaaa

SEQ ID NO: 12806 - DNA, 6659 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 12807 - DNA, 6296 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 12808 - DNA, 2921 bp, Homo sapiens
ctaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactataaaaaaaaaaaaaaaa

SEQ ID NO: 12809 - DNA, 2847 bp, Homo sapiens
ctaggagctggcggtccgagctgtggcttgaaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactataaaaaaaaaaaaaaaa

SEQ ID NO: 12810 - DNA, 2805 bp, Homo sapiens
ggggggagaggtagatcatgatttgggcggcaatgtttgctcactctttcccttactagagttctgccatagaatcatggagtcaacatcccaggacagaagggcaactcacgtcatcactataaaaccaaacgaaactgtattgactgcatttccctacagacctcatagctctctgctggattttctgaagggagagccaagagtcttgggggctacccagatcctgcttgctctaatcattgtgggctttggaactatatttgcacttaattacatcggtttctcccaaagacttccccttgttgtcctcacaggatatccattctggggagcacttatttttattcttacaggatacctcacagtaaccgataagaaatcaaaacttctgggtcaaggtgtcacgggcatgaatgttatcagctccttggttgcgataactgggattactttcaccattctcagctacagacatcaagacaagtactgccagatgccatcctttgaagaaatatgtgttttcagtagaactcttttcattgttctgtttttcttgccttcggatgttactcaaaatagtgaacaacctgccccagaagaatatgatcaattacaatttgtgcttcaagaagagttttccagtgatgattcaacaacaaatgcacaatctgttatctttggaggctatgctttcttcaagttaacactctctaggagtcctttagtctcccaaccaggtaataaaggtagagaatttgtgccagatgaacaaaagcaaagtatccttccatctcccaaattttcagaggaagaaattgaacctttgcctcccacactagagaagaagccctcagaaaatatgtccattcagctagactctacatttaaacaaatgaaagatgaagatctacaatctgctattgtacaaccttctcaaatgcaaaccaagcttctgcaggaccaagctgcgtcactccaagtttttccatcccattctgcactaaaactcgaagatatatcacctgaagacttgccatcccaagctctaccagtagaaggcctgtcagaacaaaccatgccatctaagtctacatcatcccatgtcaaacagtcttctaatctgacagctaatgacctgccccctcaaggcatactatcccaagacacatcatctcaagatatgctgtttcatgacatgacatcccaagatatgcaatccctagatatgctatctcaagacacaccatcccacgccatgccacctcaagacataccttcccaagatatgctatcccaagctctatcagcgcatgccatattacctgaagcctcaacatcccatattgtgcagttccctgaaatacaacacctacttcagcagcccccagatcttcaaccagaaaacactgaacctcaaaaccagcaaattttacaaatgtcatatcaagatattagatcagaagttatggaagagaccaaagaatggaaatctgaggaggaactccatagaagaaaatcctcaagacggcattccttaaaccagcaaaccaaagccttgcaatacttaaggagacattctttagacgtgcaagccaaaggccagaaatcctcaaagaggcattccttagatcagcaaagcaaaggctggcaatctccaaagcagaaatccttagaccagcaaatcaaagactggctatccccaaagaggcactccgtagataagcaagctcaacttaatcaaactaaagagcaactcccagatcagcaagctgaagatcagcaagccaaaggggaacaatacccagaaggacaatctaaagatagacaagttaaagaccagcagactgataaggagcaaaactcaaagaagcaaacccaggatcagcaaactgaagaccagccggcccaagagaagaaatccccgaaaggacaattccaaaatgttcaagccgaaggacagcaagctcaggtggagaaagtgccaaaactgttatgccaagattcagaatcccaaatacagcaataccaattctggcaattccacaaaggcaatctccaggctggacaacccaggactgtcaatcttttggccaagaatcccctgactggataactcagggctggagaaacaaagattataaagcacgagaatggcaatttgaaatgaagcactggcaaacacaggatctattagagaaagaagccctaaagcagaaagctctataccaagaagtccaaacccagcacgcaacagcccaacataacctagaatgtcaagacactcaagataaagaccaacaagaccttcaatccagagttacacaaaaaggagatatgtacactagagacatcaaaccaggggacatgaaatgtatagggcaaacctcaggggacctgcaatcagaagacgtgaaggcagattttcattcttcttctggccaaagctcagtacaagacacatgtttagcctatttgtccaatctagattcagaacaagatgtgcaaccagacacttcagcttcctcaaattcatataaagaagatgtgaatttaacttctacttcatgtgatccaaaagatcaacagcaatctgaagactctgactaacatgcagaatctacccaataccacactgcccccattaatggaattaaattgggaaaaacaatattgcctcctccaatctgtgttctcaactgtggttgccacctcattaacttacaaaaaaatgaagggcatgctgagcactcaaacaatttgttcttacttaaaataaaatgacaacaaaccaaaaaaaaaaaa

SEQ ID NO: 12811 - DNA, 7213 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagcaaaaaaaaaaaaaaaaaaaa

SEQ ID NO: 12812 - DNA, 7259 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagcaaaaaaaaaaaaaaaaaaaa

SEQ ID NO: 12813 - DNA, 2258 bp, Homo sapiens
agggaagctcctataaagggctgcatctctggactcacagctatcagaccattgagatgtggaagctgttgctgtgggttgggctggttcttgtgctgaaacaccacgatggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggaacagagagctgaaaacactactgtccatcggcgggtggaactttggcacctcaagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagagctcctgtttgccttccggaaggaggcactgctcaccatgcgcccgaggctgctgctgtctgctgctgtttctggggtcccacacatcgtccaaacatcctatgatgtgcgctttctaggaagactcctggatttcatcaatgtcttgtcttatgacttacatggaagttgggaaaggttcacaggacataatagccccctcttctctctgcctgaagaccccaaatcttcggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgagatttgttcctttgtctggggagcgaagaagcactggattgattaccagtatgtcccgtatgccaacaaggggaaagagtgggttggctatgacaatgccatcagcttcagttacaaggcatggtttataaggcgagagcattttgggggggccatggtgtggacattggacatggatgacgtcaggggcacgttctgtggcactggccctttcccccttgtctacgtattgaatgatatcctggtgcgggctgagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaatgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccaaaaaaaaaaaaaaaaa

SEQ ID NO: 12814 - DNA, 1968 bp, Homo sapiens
cagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacgtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaacctgaggtatttttcatgctatctaatcatatacctaagataaaccaacccagttacttatattaataatattcagaaaaaaaaaaaaagaaaaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgttttgctgcacacaaaaacaaaagatataaaaatggatcataaacatttttctaaatcctgaaaaatgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtc

SEQ ID NO: 12815 - DNA, 2825 bp, Homo sapiens
cggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattc

SEQ ID NO: 12816 - DNA, 2239 bp, Homo sapiens
agtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttccttcttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgagataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctggctttctttctttctttctttctttctttctttctttctttctttctttctttctttcttgctttctttcttgctttctttcttgctttctttctttcttgctttctttcttctctctctctcttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggctgggattacaggcatgagccactgcacccagcccagttctttcttaaaacagctgagagttttgttttcttcagcgttcaccttccttgtctccagttccgatgctggcagtggttcctacctctgttgggtttctagatagtttgggaacggggttgatgggtttctgtgaaacacattttccaagtcttgggctttctctggaggggaaggtggatgctggcgggtgacttgcagtgggcgcctggcagtgggtgtggactgtaactgacaggtggaaatgagtaggggcactattgttccctccatgccagctttttttttgctggaaatgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaagggggtgtgccaggcctgaactgagctaagcacctgccccgggctccacacttccatctttcttttgtcttcatttcacctctgtgtttaaagcactgtgtgacatagctccttagagatataacctattgtctgctcattgtcaaaaaaaaaaaaaaaaaaaaaaaaaa

SEQ ID NO: 12817 - DNA, 4798 bp, Homo sapiens
atggaacactgagacaccgacggaatgctccgaatcgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttcccactggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 12818 - DNA, 4751 bp, Homo sapiens
ggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaaaaaaaaaaaaaaaaa

SEQ ID NO: 12819 - DNA, 4828 bp, Homo sapiens
ggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaaaaaaaaaaaaaaaaa

SEQ ID NO: 12820 - DNA, 2402 bp, Homo sapiens
aagagaggaaggcttaaagagccagactgcgcagccaggactggggtatgggcgctgtcctgcaggccaaagaatgaagatgtagccccgcccccaacctaggaggaggaccagcccggttcctgtcctgcccccgcaacctcgccccgattccactccgggaacctcggcgatgctgagccaagaccacttctgaatcagggatgacttgtctagtgaacgtagggtcagagccatcagttggaaaggctgggaggagcctggagaaagaggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagttaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttatagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggttctagcagtaaaaaaaaaaaaaaaaaaaaaaaaaaaa

SEQ ID NO: 12821 - DNA, 710 bp, Homo sapiens
cggcggccgcgcgcagcacgctcaaggccgggatggcggcggcggcggcggcaggaagcgggacgccccgagaggaggagggacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcaaaaaagaaaaaaaa

SEQ ID NO: 12822 - DNA, 1769 bp, Homo sapiens
gcgcggaggtgagtcggtgtgttgtggactcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgaggcactgggtgtgtgtgcaaagccaaaaaaaaaaaaaaaaaaaaaaaaaaa

SEQ ID NO: 12823 - DNA, 1490 bp, Homo sapiens
ggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttaaaaaaaaaaaaaaaaaaaa

SEQ ID NO: 12824 - DNA, 3963 bp, Homo sapiens
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggtcggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctgaaaaaaaaaaaaaaaaaaaa

SEQ ID NO: 12825 - DNA, 1021 bp, Homo sapiens
atcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtc

SEQ ID NO: 12826 - DNA, 4925 bp, Homo sapiens
gaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaggctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaacacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcaaaaaaaaaaaaaaaaaaaaaaaaa

SEQ ID NO: 12827 - DNA, 2938 bp, Homo sapiens
ctccgggttcatgtagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgtcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctcctaaaaaaaaaaaaaaaa

SEQ ID NO: 12828 - DNA, 1370 bp, Homo sapiens
gcgggacccaactgattgtcaaaggcggcagattgtagtttttgttttggccggaaaggcttaccatgagttgccagggctgagagagatggagaaggattcgcggcggtgacagattaaattccccagttacattatagacttggaggtgggggatcttctcatcgttagaggccccgatcatgggagataggcggttcggagccagttctgcctaactttgtgttcactgatgttagggctgctagggctgcaaaggtgggcacccctactcgcctaagagctttctcctctcttctctttttcccctttgcctctctccttacatcacctgcccactaagtagacttgtccttgtgtggacgggagccggaaagccttgagaacttattcctcgacccggacatggcacaggagaaaatgaaactaggtttcaagtcgctgccgagttccactaccgcagacggcaacattctgagaagagtcaacagtgcccctttgatcaatggacttggttttaattcacaggtgttgcaagctgacatgttaagaattaggacaaacagaacaacatttaggaatcgacgctctctgttgttgccacctcctccctttcatggttccatcagccgccttcatcaaatcaaacaggaagaagccatggatttaataaatagagaaacaatgtctgaatggaagctacaaagtgagatacagataagtcactcttgggaagaaggcttgaaactgaatgacaatggcttacagaaatcatcctctctaaagtgcattgatttaactccagtatcctcaatggcttcttccatcaagaagactgggaagtctacttccagctacttttgatggaaacgacagcaatgctggatcttctggtaattcgtcagctgaaatcggcactgtcacaaactctcctgtgtcaccttctgatactggttctcatttgttctagtagacaaactttcaactaaatgattcacccatcccaagactttctcaccagtggagaaacacacacatcaagcaaaccaagtcagagcaatgagaattgtactgtataatttaaactatctcctatttatcttttttcctcaatttcctaaaattctatttatctacagaacttgcgtgtataattcttgtgtacatccttaaatttaatgtaataacatgttaaagatgttttccaaatcagaaccatgttgaagatacaagcgtaaattgttaggctgctattttctagaaaatgctgtaccttgactttttaaaataatcttatgaaacataattctgataaaatataattgttcaattaacaaaggaaaaaaaaaaaaaaaaaaaaaaaaaaaaaa

SEQ ID NO: 12829 - DNA, 6089 bp, Homo sapiens
ccatgtgcaccaacatagtttacgagtggctcaaagcgctgcagcttccgcagtacgcggagtccttcgtggataacggctacgatgacctggaggtgtgcaagcagatcggggacccggacctggatgccatcggggtgctggcgcccgcgcaccgccgccgtatcctggaggccgtgcgccggctgcgggagcaggacgccaacgccgccggcctctacttcacgcttgagccgcagccggcgccccccgggccgcccgccgacgccgtccccaccggccgccggggggagccgtgcggcggcccggcccagggcacccgcggggactctcgcggccacacgaccgccccccgcagcagggagctggtgagctaccccaaactgaagctgaagatcatgatcagggataagctcgtccgtgacggcatccacctgagcaagcccccgtactcccgcaaggtcccaatggctggcatcctagagtacttaatgaattggccgaagtcatcacagagccgctagatatcatttttgagacctcgtggaggactgatgaggtgcctgaagactggaaaagggcatatttagaaccttctttcaaaaagggaaatggatgatgaccctggaaatactcatcagcttaactttttgcttggacaaattctggaataatcaacttagtaaactgggtaactggcttataacagctagaaataaggcagtgaactatcacgcataaagaagtattgagttcatttttttaagaagatatcatgatgagatacagtcttatgcatttcttggcattctcccttccattcttaatgaaaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttggctcacagtgactttcgcctcccaggttcaaggaattctcctgcctcggcctcttggtagctgggattacaggcacgcatcaccacacccagctaatttttttgtatttttagtagagatggggttttaccatgttggccaggctgttcttgaactcctggcctcaaatgatccactcgccgtggcctccagtagcgctgggattacaggcgtgagccatcacacccggcctggatgctggtagttttattttctgcttagaaaacgcaaccatgttgatgggaccaaaaacttagttgaaagaagccatggcaaaagatgttgacgtacaactggctcctgaggctgtcaattgtttagagctcccaagtagtactgcattacggaatctactacttagaagaatgtacaagatgtaagttcccatcggcaccgtcatggtaagaagaataagaaactctcaaaggaaaagaaacttacattcactttttcctggtccattttggttcctaagaatagataggccattaagaaggatattaggtttctaaggacaattttaacacaatactgctttaaaaatctgaagtttaaatagtttagctatttctgtaggttaattcaggcactgactaaaatcagtctcattatcatatacaaatgtaaggaagttaaattttaaaagcatgtataggttgtccttaaattatacaaaagcttttagtttcatcaggattatattccagttaacctttcatcttttttttttttccaaatgaactagggtctttaaaattcctaagtagattcttttgagtggtaggggagtctgtatagattacagatataatttattgtgataacaaatggcttcctgtttgacctcatttccaggtgtcgcatccgtggctgatttatttcacagatgtacatttgcatgtacttgttgaactttgctaggaaggactcaatttttgaaaaatctgttattttcactgtgggccttatgaggcaatctactgcaatggaaaaagggttccttggtcatttcaagttttattttctattagagtaatatctaacttcaattattttgccaggtttaaaccttctctctgtgtctgtggttagaatttgaaaataacaatgctctgcttaaagtaagagtcacagtcagcaaaaaaagccaatggattttaaaaagacatcttagttaaagctagaggaagaaaacttcaaataagcaaagaagtattgaaggatgcccacgaattcctttgcattaaaatcaagatgaggtaagaggtagaatataagagaaagggattatttttaccatgaattgtatctggggacagttagtcttagaaggagtaattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctcaaaacaaaacaaaacaaaacaaaacagcaaattcataaaggccagcagttttcaagtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcagatcatttgaggtcaggagtttgagaccagcctggccaacatggtgaaaccctgtgtctactaaaaatacaaaaaaaattagctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcg

SEQ ID NO: 12830 - DNA, 979 bp, Homo sapiens
agcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggaaaaaaaaaa

SEQ ID NO: 12831 - DNA, 2372 bp, Homo sapiens
aacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacattaaaaaaaaaaaaaaaaaaaaaaaaaaaaaaa

SEQ ID NO: 12832 - DNA, 5014 bp, Homo sapiens
gcgcggtcgcctttgtgtgggtcgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggagctcttgtccctggcaaagcgaaagcgcagtgactctgaggagaaggagccgcctgtgagtcagcctgcagcctcgtcagactcggagacgtctgacagtgacgatgagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaagatttgaaatcaagaaaaaactaaaaacagccaaaaagaaagaaaagaaagaaaagaagaaaaagcaagaagaggagcaagaaaagaaaaaactgacacagattcaagaatctcaggtaacatcccacaacaaggaacggcgttccaagcgggatgagaaactagacaagaaatctcaagccatggaggagctaaaagcagagcgagaaaaacgaaagaacagaacagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggtcgctgagattacgggtgttgtggaaactgccaaagtttaccaactaggtggcaccagaacaaacaaagggctgcaactacggcatggcaatgaccaacgcgtgttccgtttagagtttgtctcaaaccaagaattcaccgaaagtgagtttatgaagtggaaagaagcgatgttctctgctggcatgcagttgcccactctagatgaaatcaataaaaaggaattatctattaaagaagctcttaattataaattcaatgatcaggacattgaagagattgtaaaagagaaagaaaggttcagaaaagctccacccaactacgctatgaagaagactcagctactgaaggaaaaggccatggctgaggacctgggggatcaggacaaggccaaacaaatccaagatcaactgaatgagctggaggaacgggcagaggccctggaccgccagcggaccaagaacatatccgctatcagttacatcaaccagcggaaccgggagtggaacattgtagagtctgagaaggcccttgtggctgaaagtcacaacatgaaaaaccaacagatggatccctttactcggcggcagtgcaagcctaccatcgtttctaattccagagacccagctgttcaagctgccatcttggcccagctgaatgcaaaatacggttctggagtgttaccagatgctccaaaggaaatgagcaagggtcaaggcaaagataaagatttgaattctaagtcagccagtgacctctcagaagatctgttcaaagtacacgattttgatgtgaagattgacttacaagttcccagctcagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgcatcacactgtagccactttgccaccacctccccacatgtagccgctgaaacccccacgagatgccaatgcacacagcagggagaaaagccaaccaaagaagaccgaagggtatctttccacccgagtagcctctgtagtgattgggaccaagactaaggacttgtctccaatctcagctgaggcagtgcctctgaaccaagatcttggtcaggcattaagacactggctttgtcctaccaactaggatttcttggtggttcacactatttcttgtgctggggaattccctcattgggcccctcctccctccacagtgtggtttcagtgttgaagggtgcagcacccaaggttgtttttatgcattttttcagttccttccaagaagcaaaaaggccagtgtccatctgcctagttcataatgtttataggtctgtttgtctgtcttgcttctggcaggtgtagggaaagtctactgcctgccactcccttcaaaaagaatgtttttgcttttgtgaagtcctgacttgccactcaaactgtaccaatattgtaaataaatgttatgccattttaacaaaaaaaaaaaaaa

SEQ ID NO: 12833 - DNA, 2100 bp, Homo sapiens
agcgcggggcaggaggagtacctcggccaagaaaattatgcatgcgttagggaagctctgagagaatggctgtggaagctctccactgtggtttgaatccacggggtattgatcaccctgcccatgctgaaggtattaaactgcaaattgaaggtgaaggtgtggaatctcaatccattaaaaataaaaatttccagaaggtgcctgaccagaaaggaactcccaagcgactgcaggcagaagctgagacggctaagtcagctacggtgaagctatctaaaccggtggctctatggacccagcaggatgtctgcaagtggttgaagaaacattgtccgaatcagtatcagatctacagtgagtcattcaaacagcatgacataactgggcgagccctgctgagacttactgacaaaaagctcgagcgaatggggattgcccaggagaacctccggcagcacatcttacaacaggtgctccagctgaaggtgcgagaagaagtcagaaatctacagttactcacacaaggtaccctattgcttcctgatgggtggatggatggggagattagaagaaaggccaccttactattaggacagacaggagtcagggagaatttgttattgtttcttcacagaatttccatcatagaaaatagtatacagatttaagattacttccctttgaaaacttttctcatagctcactagggagaaggatgcacaaataagtaatggatgagcaaacagaattacctgagctaacttcaaggtggtcacgtacagttgtatggattgtgtactgcacaaccccagagaataccagtcacatcaatcagggtacgattgcactcactagagttgtataatgtgcagcctgcacaactgtacagtccagctgtagctatcttcacctgcgccaattgtgagggcgctttagcatttgagtgattcaatagttacgatgaccagtgatataagtggagtttttgttgtatttttgttttgcttttcaccggttagtgggagaaaaacattttagatatgtattactatacatgaatgtattatacacacacactttagagattgtaagaaccccatttagcttcttgaaagtggaataatttttataatagactatagtgaatctaaaactacactgttaagagtatataattcttaacaggaattataaataacttcaatatgatgagagcacttaagatctcaataactgtggaagtgacaaaataaagctagaattcgaagaaagccttaagttacactatatgtaactgatatgtctacatgagatttggatgctatcaaccttcattggctataaactttgtttgttttattttagcgtccattgtacatcgttttaaatgaaaggatgataaaatatgtgtttttgagagccttgagtatttgtcattctgcagaatattgtaattgcatgcataccgatattggagaaatctgggtcagccaagtttcatgttattgcatttagattaacctagtaatagtccatttgcctagaggaaataatgtgctccctgaaagatgactattctagaaggataaatatagatttcaagtgatcgtaaaatagtattgtttgtctcatatgcattatttgcattttgtcctcagagatttccaatggtgaatttactggtatactaagtgatttaaatttgaatgtgaaatactgataggcttttaagcttcttttaagaagtagatagaaatacgaagattatgataagaaagtctgtcacagtgctatttggaaaacggaaaatttacaagcaacctagaggtccagcaatgtgaaaagaatcaagtaattctgcttaaattcataagattcagtataatgcccagttattaaaattacatctttaaagaatacatgacaacatgggaaattacgtaagtcatacaaggtgggaggaaaggtcatgtgtaaaattgtatgcataatataagcccaattttgtaaaaaccatatattcttatatgtacagaaaaaaaggactgcaagtaaatatgccaaccattttaataaaggatctctctggattgtggg

SEQ ID NO: 12834 - DNA, 3234 bp, Homo sapiens
ggctagcgtcagcgccagccagaattaaggaagttcactggagtaaaatggaggcctcagtaatattacccattctgaagaaaaaactagccttcctttcaggaggaaaggacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccacgcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttctttttatgacacatttctctttacatgttaacaccttactactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattcttaggactgtgaggatggtttaatatttgttttttcatggtggttgcatgtattttagacaggaaatacatatgtaagcatgtgtatataataaataagcatgttttatcatgaaaaattattgtgaacaatttagatctttaagaacttattaataatggaatactatttctaatttttctctttttcaacttgaaaaatattctcaaaattattaactaccctgaagatactttgtctttaggggaggagggctgaggaagaaggcatacataattacttcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaat

SEQ ID NO: 12835 - DNA, 4229 bp, Homo sapiens
ggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagttcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattg

SEQ ID NO: 12836 - DNA, 3946 bp, Homo sapiens
cgtttaaaagccatcagatttgagagcaataagtcttcaaaaccgggaatttacattgtttttcagctgaccgacttccaggaaaaggactcaaccgcatctacccaaataccgtggcactgcttgcgctctttgccaccggatactccccttccaatgagactttctgattgtgtctaccaactctcctattaggaaacccgtgggttgcatgcagctattctgttgtattctcattctcactctccctcccttctctcactctcactcttgctggaggcgagccactaccattctgctgagaaggaaaagcccgcaactactttaagagattaagacaatatgcgcaatcctcgcctttcctagcaatcactatttaaatctggcaagaactgacaacagtctttgcaagaatggaatccgtaaaacaaaggattttggccccaggaaaagaggggctaaagaattttgctggaaaatcactcggccagatctacagggtgctggagaagaagcaagacaccggggagacaatcgagctgacggaggatgggaagcccctagaggtgcccgagaggaaggcgccgctgtgcgactgcacgtgcttcggcctgccccgccgctacattatcgccatcatgagcggcctgggcttctgcatctccttcggtatccgctgcaacctgggcgtggccattgtggacatggtcaacaacagcaccatccaccgcgggggcaaggtcatcaaggagaaagccaaattcaactgggacccggaaaccgtggggatgatccacggttccttcttttggggctacatcatcactcagattccgggaggctacatcgcgtctcggctggcagccaacagggttttcggagctgccatacttcttacctctaccctaaatatgctaattccatcagcagccagagtgcattatggatgtgtcatctttgtcagaatactgcagggacttgttgagggtgtgacctacccagcatgtcatgggatatggagcaaatgggccccacctctagagaggagtagactggcaaccacctccttttgtggttcctatgccggagctgtgattgcaatgcctttagctggcattcttgtgcagtacactggctggtcttcagtgttttatgtctacggaagctttggaatggtctggtacatgttttggcttttggtgtcttatgaaagtcctgcaaagcatcctactattacagatgaagaacgtaggtacatagaagaaagcattggagagagtgcaaatcttttaggtgcaatggaaaaattcaagactccatggaggaagttttttacatccatgccagtctatgcaataattgttgcaaacttctgcagaagctggactttttatttattgcttattagtcagccagcatattttgaggaagtctttggatttgaaattagcaaggttggtatgctatctgctgtgccacacttagtaatgacaattattgtgcctattgggggacaaattgcagattttctaagaagcaagcagattctttcaactacgacagtgagaaagatcatgaattgtggtggttttggcatggaagccacactgctcctggtcgttggctattctcatactagaggggtagcaatctcattcttggtacttgcagtgggattcagtggatttgctatatctggtttcaatgttaaccacttggatatcgctccaagatatgccagtatcttaatgggcatttcgaatggtgttggcacattgtcaggaatggtttgtcctatcattgttggtgcaatgacaaagaataagtcacgtgaagagtggcagtatgtcttcctgatcgctgccctagtccactatggtggagttatattttatgcaatatttgcctcaggagagaaacaaccctgggcagacccggaggaaacaagtgaagaaaaatgtggatttattcatgaagatgaactcgatgaagaaacaggggacattactcaaaattatataaattatggtaccaccaagtcttatggtgccacaacacaggccaatggaggttggcctagtggttgggaaaagaaagaggaatttgtacaaggagaagtacaagactcacatagctataaggaccgagttgattattcataacaaaactaattactggatttatttttagtgtttgtgattaaattcattgtgattgcacaaaaattttaaaaacacgtgatgtaaacttgcaagcatatcaaccaggcaagtcttgctgtaaaaatgaaaacaaaacaaacccatgaggttaccatcaagtgcaatctgtaaaattgtgaagttccatcatttccattcaagtcatccattcttgcatttgtgacttaaaggttgactggtcaaaattgtagaaacaagtagttacccattggattcatatgagctaaaactcatcactatttactaaagcacaacatctcatcctacaaaagttaagaagccaaagctacttgatcatgcaaaatgcacttatatatttgttacactgtattgcaagatagcacacagaagttggctgcgtcaagtagaggcgacatttattaagtgaaaatcatggagttgggatatctctcaattaaagaaatacattgtgaactatcagctacaaagttgtactgaataactattagaattgcataatgtgagatattttgttagtcctcaaaaggaatatcttgcagtgttttctatgaaatgcttgggcacaaacacttatttctgtgaaagagaacatgtaagttgaggggtatgcttcatgttcttccatccatttacctaatagtatgaaacagttcacatttcaataaaatcaaacttttcatgtagcgtatcacataacttttttgcaaaaaatataaaaagaaataaacttcaatgtattttttattacaactttgtactggttgtaacttgcattagaaaaaaaaaagagatatataaaccacaaagaatctaataagaaatttattatggagatatagcccttaaaatgcaatattaagaacaaagaaatagaaaatggtttagatatctttcttccttcataattaaatactatatgaaacttgtgccacagagctatatgtaatatgaaaagattaacttcatagagatattgtaagtaggtaattttattatttaaagtcctattaagaaatatttgtcttaaatatataggacaatacattatattaaaatggtctctctctatatatatctgtatatcttatacatgtccatacacagaaacataataaacaatcttcacacgaaaccaaaaatagcatacacctaatgttgggttagggaattgcaatttctactttcatagagtcatagaattttaggtggggaagaggcattttgcttgtcatttcttaatataactcaacaagaattgcaacatttgtgtaccaagcaataagtgcaatgcataaaatttcctgtctgtatattaccttcattttgcttgtagtagctgtttgggtggttggaataattttatttttcttttaaaaaagctaacatcagacccctttataatgtcctaaaattatgataatacatttcccaattcaactcaaaatattattggtgtattttgtctattctggatatttgatctgtttaatgtactgtgctagtgactggaggccctgctactgcaaatataaaacctaaagtttgtttaaaaaaatgcaaatcattctttaccttaagaaaaaaaaaataccctttgctttgtgcctcaaagtgatgtaatgtgatcacagcttttgttgtgttgaatgaaaatatgtggactgtcattttgttgcagcaaaaaagtgttaataaaatgctctatttatccttttttaaaaaaaaaaaaaaaaaaaaaaaaa

SEQ ID NO: 12837 - DNA, 2907 bp, Homo sapiens
actgcccccgccactcctttagactctggacgtgcggggactggtggcgctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcagaacttatacacaacacaaggtttcttctttgaatgcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgttttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaactaaaaaaaaaaaaaaaa

SEQ ID NO: 12838 - DNA, 2869 bp, Homo sapiens
actgcccccgccactcctttagactctggacgtgcggggactggtggcgctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgttttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaactaaaaaaaaaaaaaaaa

SEQ ID NO: 12839 - DNA, 4807 bp, Homo sapiens
gcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatgatgtttgtttttcacattgattttctttgtatcacctgaactggattgtctttcatttcagtcagcacttagacatttcataataactaaacatcacattccaagtgggatgaattacattaattgaatagagttaccaccgcttcagagtctaaggaaaaatagagtattatggttcaatggtgttcttatgtagtcttatgattcttgaaaaagtacttacagcctcccaagaaaccatgtgtacaattgactgcttgctgattcaatattgtctgcaaagtataaaagactatgatttttaaataaaactgttgtatatatgaaattggatagagcagaggaacctcactgagtgtcctctagttaaaaatctttcatttatcctaccaccagatcagttacatttttaaaacaatgatggatatagcagcaaaataagtgaggtaatacacatgccatatcaattgatttatttcagccagtattctcgctctgctatagatagatgttaataaatggtatcacagcatttaaagtattaaatccactggtgcataaatttttagtcttttaaaatatattcatgaatattgtgtttgtatccctttaaaatgtttaatattttataaataggcagtatatgcacattatacaaaactaaaaaattatgacaattcagtgtgaagtaagttctcatccaacatttctcctggccatccattctccatctttaaaggcaatcaccattgccagtttcttctgtatccttctggaaatacaatatattacataaatgacagcattctatattctctcttctatatcttacctatttctgtgaataatttattttggacagcattttatgtatgaatattcacaaatgtgcttccttatttcagaggctgaactaataaaaattttgtttatttttgtgttgaggcaatatttttatatggtaccctaatctttaatacttaacctgccagactttaaccgtaacacaataatgtattgccaaatagcaccattcttcttctctcactctcttgccatgggggctcttaaaaaaaaaagtatacatctaaggtgtacaacatgctgttttgatgtatataaatatagtgaaagcaaataaagtatatatctaaggtgtacaaaaaaaaaaa

SEQ ID NO: 12840 - DNA, 1385 bp, Homo sapiens
gggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggat

SEQ ID NO: 12841 - DNA, 1873 bp, Homo sapiens
agggatcccaccccttctctgtgttttcactctgaagctctacacaactttacacctgaatgaacgccaaacctctatggatatataaagggaagcttgaggaggaatttcacagttacagtgcagaagcagaagcaaaagaattaaccagctcttcagtcaagcaaatcctctactcaccatgcttcctcctgccattcatttctatctccttccccttgcatgcatcctaatgaaaagctgtttggcttttaaaaatgatgccacagaaatcctttattcacatgtggttaaacctgttccagcacaccccagcagcaacagcacgttgaatcaagccagaaatggaggcaggcatttcagtaacactggactggatcggaacactcgggttcaagtgggttgccgggaactgcgttccaccaaatacatctctgatggccagtgcaccagcatcagccctctgaaggagctggtgtgtgctggcgagtgcttgcccctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttattgttgttgcctctaacatgtataaagggtgcaaaaattgtagaataaatgtataagggtaaaaaa

SEQ ID NO: 12842 - DNA, 2186 bp, Homo sapiens
ggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtatcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaaaaaaaa

SEQ ID NO: 12843 - DNA, 3214 bp, Homo sapiens
gggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaaaaaaaaaaaaaaaaaaaa

SEQ ID NO: 12844 - DNA, 3967 bp, Homo sapiens
aggtgcaacattagaggaaatcaatcagcactgggactggctggaacaaaatctcctccacaccttgtctgtctttgataataaagatgacattgccagttttgtcaaagggaaggtaaagccgtgtgtctgggtggctgacggatgacacagctgagccattctcctcatcaggtgtgactgtcgttgaagcagcgcacacttctcgggggcctgtgcacctcagtccctcctgcttcctgtcccttgcaccccctgccttcccattgctggctcactgagcagggactgtcatctctgtgtgtcaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccgcggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtctgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagacgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcacttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtatccattggttcccttgatgccaacttacaatttttaccggatttgctgaaatgggcacttctgctgtgatgctagtgttgattttgctctcagatgaacacaatgtctcatactaaccaagaagcaagaaaagccccatgctttcatttttcacttggagtgacaatgggagaggtcaggaatcaagttcactttcaagatctaagggagtccactatctgtgcaattgtatttggcttttttttgcactgtttcaatgctggtaattgaaaccattttaatatatttggttgtattcactttatatgtccttccaaaaatgttgttgtgtacataccatgctttcaatgttggcttccaagttttttaataagaaactttttgtttttt

SEQ ID NO: 12845 - DNA, 4952 bp, Homo sapiens
gcacattctttcaagtgacagctatagcctgtcccaggggctgctgtccacagcttggggctgaagactcccaggccattaaccccttagcttttaggaagattactccccctttttcaaggccccatccacctccctcccttgactcccaggacgggaagttggccatgttcccaggagggaggccggaggcccatggatgggggtggagtatgtgttgggaggggggacctcctgtccagtcctcaggccctgggacagctgctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaa

SEQ ID NO: 12846 - DNA, 4862 bp, Homo sapiens
tcctcacaccagccagacagcctaccctccgcccaggggaagcggctgcctccgccaggccgcttccaggaagccccgggccaggccccagcattgttcaggccctggggccagcaccccagccagccgaacaccatgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaa

SEQ ID NO: 12847 - DNA, 4690 bp, Homo sapiens
gctggccgtctgcgcaccctctctcccctcggctctttcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaactttagccgaaa

SEQ ID NO: 12848 - DNA, 4749 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagaa

SEQ ID NO: 12849 - DNA, 937 bp, Homo sapiens
agttcacctgcagaggaggctccagaaagcggcatgtcccctttgctctttggggctgggctggtcgttctgaatctagtgacgtctgccaggagccagaagacagaacctctaagtggctctggggaccagccactcttccgtggagctgatcgatatgactttgccatcatgatacctccaggaggcacggaatgcttttggcaatttgcccaccagactggatacttctatttcagttgcgaggttcagcggacagtggggatgtcacatgaccggcatgttgctgccacggcacataacccacagggatttctcatagacacctcccagggtgttcggggccagattaacttctctacccaagagacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggacggcacacaaaaggtgcagaacaatatctttcacatgtggcgatactacaactttgcccggatgaggaaaatggctgactttttccttatccaatcaaactataactacgtgaactggtggtcgacagcccagagccttgttattattctttctgggatcctgcaactgtatttcttgaagcgtctcttcaatgttccaacaactacagatacaaagaagccaagatgctaagctaaggtgactatagcaccctggctgttttcttctggggcttagtcgaatcagctttgtaatgttatgggacaaaaatcaattatctcattaatgttttagtctgctgcacacatctaaaaaagcaaaatggcaataaaatcataacagcaaaaaaaaaaaaaaaaaaaaaaaaaaaaaa

SEQ ID NO: 12850 - DNA, 1011 bp, Homo sapiens
ggcacaacagagccgctcccctctcctcgccccgccaccgggacgagaggcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataataaaaaaaaaaaaaaaaaaaaaaaaaaaaa

SEQ ID NO: 12851 - DNA, 805 bp, Homo sapiens
cccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacacttaaaaaaaaaaaaaaaaa

SEQ ID NO: 12852 - DNA, 692 bp, Homo sapiens
cccgagacctcccggcagtcttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacacttaaaaaaaaaaaaaaaaa

SEQ ID NO: 12853 - DNA, 1064 bp, Homo sapiens
gccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccgttctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaaaaaaaaaaaaaaaaaaa

SEQ ID NO: 12854 - DNA, 4250 bp, Homo sapiens
gcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaactaaaaaaaaa

SEQ ID NO: 12855 - DNA, 4035 bp, Homo sapiens
gggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaactaaaaaaaaa

SEQ ID NO: 12856 - DNA, 3966 bp, Homo sapiens
gggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaactaaaaaaaaa

SEQ ID NO: 12857 - DNA, 3098 bp, Homo sapiens
tcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttgacattaaagcaatctgttgaaatgccaaaaaaaaaaaaaaaa

SEQ ID NO: 12858 - DNA, 2399 bp, Homo sapiens
ggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggttccttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccggccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaaaaaaaaaaaaaaaaa

SEQ ID NO: 12859 - DNA, 1616 bp, Homo sapiens
cgggacctggacacccagaatccacgaaaagcaactcgcgctcgagaacagctctcgtacccttctacgtgatctgcacctttaagctcactccatcccaaaccggaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgccatggagacgcggcctcgtctcggggccacctgtttgctgggcttcagtttcctgctcctcgtcatctcttctgatggacataatgggcttggaaagggttttggagatcatattcattggaggacactggaagatgggaagaaagaagcagctgccagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaacatgaatgtgccccttctttcatcagagttagtgttctggaaggaaagcagcagggaagggaatattgaggaatcatctagaacaattaagccgaccaggaaacctcattcctacctacactggaaggagcgctctcactgtggaagagttctgctaacagaagctggtctgcatgtttgtggatccagcggagagtggcagactttcttctccttttccctctcacctaaatgtcaacttgtcattgaatgtaaagaatgaaaccttctgacacaaaacttgagccacttggatgtttactcctcgcacttaagtatttgagtcttttcccatttcctcccactttactcaccttagtggtgaaaggagactagtagcatcttttctacaacgttaaaattgcagaagtagcttatcattaaaaaacaacaacaacaacaataacaataaatcctaagtgtaaatcagttattctaccccctaccaaggatatcagcctgttttttcccttttttctcctgggaataattgtgggcttcttcccaaatttctacagcctctttcctcttctcatgcttgagcttccctgtttgcacgcatgcgtgtgcaggactggctgtgtgcttggactcggctccaggtggaagcatgctttcccttgttactgttggagaaactcaaaccttcaagccctaggtgtagccattttgtcaagtcatcaactgtatttttgtactggcattaacaaaaaaagagataaaatattgtaccattaaactttaataaaactttaaaaggaaaaaaaaaaaaaaaaaaa

SEQ ID NO: 12860 - DNA, 4299 bp, Homo sapiens
gtgacgcgaggtcacgtgacgggttgggcagcctgtgccgccgccgccgctttgtaagaggcacattggcagattttctattttgtacatacattattttgtatatactgtatatgatgacttcagtgagcagtgaccattgtcgaggtgctcgggaaaaaccacagatttcagcagcacaatcaacgcaaccacagaaacaagtggtacaggcaacagctgaacagatgcgtctcgctcaagtgatctttgataagaatgattcagattttgaagctaaagttaagcagcttatggaagtgacagggaaaaatcaggatgaatgcatagtggccctacatgattgtaatggagatgtgaacaaagctatcaatatattgctggaagggaattcagacacaacttcatgggagactgtagggtgtaagaaaaagaattttgcaaaagaaaattcagaaaacaaagagaatagagagaagaaaagcgagaaagaatcgagtcgtggacgtggaaacaacaaccggaaaggaagaggcggcaatcgtggcagagaatttagaggtgaagaaaatggaattgattgcaatcaagtggacaaaccttcagatcgtggcaagcgagcccggggtagaggatttggacgtggcagagggagaggggcaggaaggttctcaacccaaggcatggggacatttaatcctgcagactattcagattctacatctacagatgtgtgtgggacaaagctagtagtttgggaagctgctcagaatggtgcagatgagggaactgaactggcatcaaatactcacaacatagctcaggatctgtcaaacaaaagttcttatggactcaaaggggcttggaagaattctgtggaagagtggacaacagaagactggactgaagatctttctgaaacaaaggtcttcactgcctcatctgctccagcagagaatcacatcttacctgggcaaagcattgatctggtagccttgctccagaagcctgttcctcacagtcaagcctcagaagccaactcctttgaaacttcccaacagcagggctttggccaagcccttgtcttcacaaattcgcaacacaacaatcagatggcaccagggactggcagctccactgccgtcaactcctgttctcctcagagcctgtcatccgtccttggctcaggatttggagagcttgcaccaccaaaaatggcaaacatcaccagctcccagattttggaccagttgaaagctccgagtttgggccagtttaccaccaccccaagtacacagcagaatagtacaagtcaccctacaactactacttcttgggacctcaagcccccaacatcccagtcctcagtcctcagtcatcttgacttcaaatctcaacctgagccatccccagttcttagccagttgagccagcgacaacagcaccagagccaggcagtcactgttcctcctcctggtttggagtcctttccttcccaggcaaaacttcgagaatcaacacctggagacagtccctccactgtgaacaagcttttgcagcttcccagcacgaccattgaaaatatctctgtgtctgtccaccagccacagcccaaacacatcaaacttgctaagcggcggatacccccagcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctccctgcccagcaccacctcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgccagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaaccagtacctcgtaggtcccggaggactgcttcctgcctacccgatctatggctatgacgagctccagatgctgcagtcacggctgccagtggactactatggaattccctttgctgcacccacagcgcttgccagccgagatgggagcctagctaataatccatatccaggtgatgtcacaaagtttggccgtggggactctgcatcccctgcacccgctaccacaccagctcagccacagcagagccaatcacagacccaccacacagcccagcagcccttcgtgaatcctgcactgccacctggctatagctacactggtcttccctactacacaggcatgcccagtgccttccagtatggccccaccatgtttgtccctccagcctcagccaagcaacatggggtgaacctcagcactcccacacctcccttccagcaggccagtggttatggccagcacggctacagtacaggttatgacgacctgacccaggggacagcagcaggagactactccaaaggtggctatgctggatcatcgcaggcaccaaacaagtctgcaggttctgggcctggcaaaggagtatcagtgtcttcaagcaccactggtctacctgatatgactggttctgtctacaataagacacagacttttgacaagcagggatttcatgcagggacgcctccacctttcagcctgccctcggtcttgggctccactgggcccctggcctcgggagcggcccctggctatgcacccccaccattcctacacatcttgccagcccaccagcagccccactcacagctgctgcaccaccaccttccgcaggatgcacagagtggctcgggtcagcgcagccagcccagctccctgcagcccaagtctcaagcctccaaacctgcctacggcaactctccatactggacaaactaaacccagaagagaggggtgggctggggcaaggcttatcctgggcaggagagaacacacgagcacgtatttgggagcccagtgccctttcctagaattcccgacatgtgtcagccatgcctctgtggggagtctgcctcccagactggctactgtatgtaatgtatttatgtatgtatttgtaaatgtgatagaagtctgggggggagttgggggatggcggcagatgttagccaggtctgccctccccattcaagccccttctccactgtagcaaaataagcacccccaccccatctgccttcaggtcttcttcacagcctgcactgcccagtgggccactaggggcagtctctggaagggctggttcaaggctgtttgggtataggggtcaggtaccaatgaagaatcacgacttgtctcactcctttggaaattgttttctttcctgtgtaattacttcatacctctgtttttgagaaactgttccgtttgtcatctgtcatggtctccttccaccaaatcttcatctgggaatagcagcggtatccctccacccaagtatggccacctgtttgtcttcatatagaacaggggcttctggtctggtcatgtccctagagacttactagagactggctgaccatgaaaaaaaaaaaaataatctgagttattcagccagtcagctcccctttaaaaatctaaggtatctccaagcaacacatctccattctagttgtcttgaaccacgtgggcaactgtttcaggggttttctcttgcccaatccccacctaataaagttctgagagcatgaaaaaaaaaaaaaaa

SEQ ID NO: 12861 - DNA, 3889 bp, Homo sapiens
gagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcaccagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgtttttttttttttttttgtactgtgtcctcaaatttaatggattaatgtgtcttgtatatataaaaagaaaacctctaccttcaaaaaaaaaaaaaaaaaa

SEQ ID NO: 12862 - DNA, 5073 bp, Homo sapiens
cgcctccccgcgcctcgttcgccgccgctgtcgccgccgccgcccgagactcgcgcagagcagttatggcggatcccgcagcccccacgcccgcagctcccgctccagcccaggccccggctccagccccggaggcagtcccggccccagccgcagcccccgtcccggcgccggcgcccgcctcggactcggcctccgggccgtcctcggacttcggcccagaagccggctcgcagcgcctgctgttttctcacgacctggtgtcgggccgttaccgtggctccgtgcacttcgggctggtgcgcctcatccacggcgaggactcggactcggagggcgaggaggagggccgcgggagctcggggtgctccgaggccgggggcgcgggccacgaggagggccgggccagccccctgcgccgcggctacgtgcgcgtccagtggtacccggagggcgtcaagcagcatgtgaaggagaccaagctgaaactagaggaccgttctgtggtgccccgagatgtggtccggcacatgcgatccaccgacagtcagtgtggcacggtgatcgacgtcaacatcgactgtgccgtcaagctcatcggcaccaactgcatcatctatcccgtcaacagcaaggacctgcagcacatctggcccttcatgtatggggactacattgcctatgactgctggctggggaaggtctacgacttgaagaaccagatcatcctgaagctatccaacggcgccaggtgctccatgaacacggaagatggcgccaagctctacgacgtctgcccgcacgtcagcgactcgggtctcttcttcgatgattcctatggcttctacccaggccaggtgctcattggccctgccaagatcttctccagcgtccagtggctgtcaggtgtcaagcccgtgctcagcaccaagagcaagttccgagtggtggtggaagaggtgcaggttgtagagttgaaagttacatggattaccaagagtttctgtccagggggcacggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccaaaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttctaagcttttgataatgtgaagctccaggccgagaggatgctgttgagcacattgcagctatgtaatttttggtgtatgtatgtaatatttaaggttggaaaaaaaaactcaaaagcaaagatattaactcttattag

SEQ ID NO: 12863 - DNA, 3207 bp, Homo sapiens
aaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaactaaaaaaaaaaaaaaaaaaa

SEQ ID NO: 12864 - DNA, 1188 bp, Homo sapiens
ggcagctgagtcagtgagcagcgccatgatgaggggcagtccctgccagcaccaacaggggctggaaacccagcgataggagcatcagcatctccgaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggatggagaagagggacgggagcgaggaggactttcacttagactgccgccacgagagataccctgcccgacaccagccacacatggcggattcctggccccggagctccgcacaggaagcaccagagctgaaccgacagtgctgggtcttggggcactgggtgtgaccaagacctcaacctggcccgcggacctcaggccatcgctggcaccagcccctgctgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgaaaaaaaaaaaaaaaa

SEQ ID NO: 12865 - DNA, 4611 bp, Homo sapiens
tggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacatcttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctt

SEQ ID NO: 12866 - DNA, 2421 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaaggaagagagacaatttagtccttactttagaaaataaatacttaagcataattgtaaaaaaaaaa

SEQ ID NO: 12867 - DNA, 4465 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccaattttatatttaaggggggtggtgggtgggagggggcaagtaaagacggaacaagtttagtagcagtaatagtaaatcatgtttacatatgagatttatagtcgtgggaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttgtcctaagtgtggaaaagtgtcttcagatttagactcttctccatgtcagctgcagcgccacccgccttacacctgcccggccgtctgtctcttggtattgggtaaaggagggggcacctgcatgtctcctgcaatgagcaaggaattatgtctcatgttttgacttcagaggctttttgctttggtgcatttcagaaaggatggagaacatttattatgtgtgaaagcatcctcttccggttttgctgttattcaaaagtgggaaatgtacctggcacgtttgaaaataaaaaatctgactacctatcagaagagtaaatcagactgaagtacatttggataacacaaggtttctataaaatttgttcttcctgtcctccatgtcactgtttcttggacctcagttctctttttgaaagcattattccaaaatgccctgagagggtctcttagatcattgtttaaaaaaggaaaaaagtatatggatgtgctgtccatccaactcaggattatcattcttagcaacacgtaaccgaagcaatattcttaagaatattgaaggggtttttttaattgaacttaagactggagtttttcctttgaaa

SEQ ID NO: 12868 - DNA, 4092 bp, Homo sapiens
gtcacaaaggggggaacacgtgggcgccggctgccggggcggcgatcttagggaactagggtcacctggagagccgcccaccgtctctgcccgctcgactcctccgcccgggccgctcggccggtccagccgcggccggcgcctggctgtgaggtggattcccggcccagtctgaccatctccctccagtttttccacttcgttcggaccttctcataactatgtccaccctctacgtctcccctcacccagatgccttccccagcctccgagccctcatagccgctcgctatggggaggctggggagggtcccggatggggaggagcccacccccgcatctgtctccagccacccccgactagcaggactccctttcccccaccccgcctgccggccctggagcaggggcccggtgggctctgggtgtggggggccacggctgtggcccagctgctgtggccagcaggcctggggggcccagggggcagccgggcggctgtccttgtccaacagtgggtcagttacgccgacacggagttaataccagctgcctgtggagcaacgctgccggccctgggactccgaagctcggcccaggacccccaggctgtgctgggggccctgggcagggccctgagccccttggaggagtggcttcggctgcacacctacttggccggggaggcccccactctggctgacctggcggctgtcacagccttgctgctgcctttccgatacgtcctagacccacctgcccgccggatctggaataatgtgactcgctggtttgtcacgtgtgtccggcagccagaattccgagccgtgctaggagaagtggttctatactcaggagccaggcctctctctcatcagccaggccccgaggctcctgccctcccaaagacagctgctcagctcaagaaagaggcaaagaaacgggagaagctagagaaattccaacagaagcagaagatccaacagcagcagccacctccaggggagaagaaaccaaaaccagagaagagggagaaacgggatcctggggtcattacctatgacctcccaaccccacccggggaaaagaaagatgtcagtggccccatgcccgactcctacagccctcggtatgtggaggctgcctggtacccttggtgggagcagcagggcttcttcaagccagagtatgggcgtcctaatgtgtcagcagcaaatccccgaggtgtcttcatgatgtgcatcccaccccccaatgtgacaggctccctgcacctgggccatgcactcaccaacgccatccaggactccctgactcgatggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagaaaggtgaccggatttaccaccagttgaagaagcttggcagctccttggactgggatcgagcctgtttcaccatggaccctaaactctcagcagctgtgacagaggcctttgtccggcttcacgaggaaggcatcatctatcgcagtacccgccttgttaactggtcctgcaccctcaactccgccatctctgacattgaggtggataagaaggagctgacaggtcgcaccctgctctccgtgcctggctacaaggagaaggtggagttcggggtcctcgtgtcctttgcctataaggtccaaggctcagatagcgacgaggaggtggtggtggcaacaactcggatcgagacaatgctgggagatgtggctgtagctgtgcaccccaaagataccagataccagcacctgaaggggaagaacgtgatccacccattcctgtctcggagccttcccattgtcttcgatgaatttgtggacatggactttggcacaggtgctgtgaagatcacccccgcacatgaccaaaatgactatgaagttgggcagcggcacgggctggaggccatcagcatcatggactcccggggggccctcatcaatgtgcctccgcctttcctgggcctgcccaggtttgaggccaggaaagcggtgctggtggcgctgaaggagcggggactgttccgtggcattgaggacaaccccatggtggtgccactttgcaaccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccgggagtggtgcatttccaggcagctgtggtggggccatcgcatcccagcctactttgtcactgtcagtgacccagcggtgccccctggggaggaccctgatgggcggtactgggtgagtggacgcaatgaggcggaggcccgggagaaggcagccaaggagttcggagtgtcccctgacaagatcagtctccagcaagatgaggatgtattggatacctggttctcctctggcctcttccccttatccattttgggctggcccaaccagtcagaagacctgagtgtgttctaccccgggacactgctggagaccggtcatgacatcctcttcttctgggtggcccggatggtcatgctgggcctgaagctcacgggcaggctgccctttagagaggtctacctccatgccatcgtgcgagatgctcacggccggaagatgagcaagtctctaggcaatgtcatcgatcccctggatgtcatctatggaatctccctgcagggcctccacaaccagctgctgaacagcaacctggatcccagcgaggtggagaaggccaaagaagggcagaaagctgacttcccagcggggattcctgaatgtggcaccgatgctctccggtttggattatgtgcctacatgtcccagggtcgtgacatcaacctggatgtgaaccggatactgggttaccgccacttctgcaacaagctctggaatgccaccaagtttgcccttcgtggccttgggaagggttttgtgccctcacccacctcccagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagagtgctcctggaaggaccccgaggcagaagccgcccttgagctggcgctaagcatcacgcgagccgtgcgctccctgcgggccgactacaacctcacccggatccggcctgactgtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaagctccaacagacagaagcagagctcaggaaggtggatgaggccatcgccctattccagaagatgctgtgatccaccacccagcttcacccctcacccccagcggctcaccatggggatggcagcaataaaatattttcccacaaaa

SEQ ID NO: 12869 - DNA, 9530 bp, Homo sapiens
agatagaataaaacttttaccttttcctggaatgaaatagactgttgtttccctggcacttaataaggatagcataatgctagaaattatattgtgttactatgttccatagtcaaaaaatcatgattactagggcaaaaccctgttcatctcttaagaagaatttaactcactttgtaattatttaattcccttctgtctatcttagaatatgtgctctttcattgcagtatctatgttatttttgaaagttctttagattgctgttaagcttcatccagattaataatgatttttcaagtataagttaatggtttctttctatgtggctttctttttaaaagaatatttatagatacttatgaattctgttagagaaaaatgtaaattttaacctgtcatgcatattaaaaacatactttttgatgatattctatgtgtcactctagaattataagccgtcctaaaagtagaaaaatctgatccatcgagattgagaaggagcatgatatagtgggaaaagcatgggttttagaatcagacgaaactgggtaaaaaaatacagttctactacttatttactttgttgccttggaggaattacatggcctttctaatttatgacttcttcatctgaaaaatggcagatgatactctcttggcaagggtgttaggagggaggagaggatgtagacaaaatacaaagtattttgagtagttgagtaattctcttctgacttctccattgagacagaaatctagccataactatgaaattctaaatattttacatttttctctaggaatacggggtgctttgcattcaggaatacagaaaaaacagcaaagtggagtcaagtacacgtaacaacttcatgggcttgaaggatcacctagggcatgacctcggccacctttatgtggagagcactgacccacagttaagtccagctgtaccttggtcaacagtagaaaacccaagtatggataccgttaatgtggggaaggatgaaaaagaggcgtctgaagagaatgcaagctctggtgactctgaagaaaacacaaattctgatcatgagtcagaacaattgggtagcatttcagtagagccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaactttttttttttaacatttcctttttaaagctatatccttggctggaaatttttccagtttgatttaatagatgtatctgtgatctttgatattaatctttggtgcatcaggggtttatatgcagcactttttatccttgttttgtgttttattaacttggtgtttgtctatcaattgcaagcaattacaataccttcagaatgtgggacatttgactagacctagcaaactgttttttcgagccaagcttagttagactcttttacagctttttaagttatttttatttggggaaagtgggcttctttgtgctataatcattatttatagaaacaaagttatactacagcactgactttatattttaaacagaatgtaagttaccagttttatgttgaaatgtgttacagtatatatatattagaatgatttacaatatggcacttttcgatgtgttatttttgtttggatttttttttctgttaagaaattagttaatttaatatggtcaatttaaaagaaagcagatgcaatcaatggaaaaatgtttccattttttaaaaatgaataaggcaaaagctgtaactgttacaggttagagctttgttatccagctatgatgtgcttcttgacagtagaagtggaattgaattcctagatttccattaacctgtatttttaatatgtctgtctttttgttttggggcacaacaatactggataaaataaccctttcacagcacttgcctgtttttaatgaatctaattattcacaatgcaacttttatatttaacatactctttagctttcctgctatttatcaaggctggcctgaggtgggtttatgtgttgaggttatgcaacatttcttgatactgcactatagagaaatggtgatggaggagttgtaaatggtaacttaaaatttttgtaagatattgtatattttccattttcctgaaggtagttttcttgggggggcctgttatattattaaggccagactcttgccacaaatagtgtagttttagatacagactaaggtctgttctagtattagtaagggatatttctggtttcaaagtcatgggttttgctagtggtgaatacatttctgcggagtagaagatagattttgcagtcagtggcagacagttgtgtgattgacatcacttgactgttgcgtccaggttttgaattgtacttcacgtaacagatgcattcagatctttttctgtagtctgcttagatgccctggctattctgattatcctacatgctacagtttgaagtgaagccctgaaaaaccagaaagtaccttttactgttgatacaaattgtatctttttaactataagaactattttgatttgtagatctagttaaaacacaagtatgtaactatgattagacttttgggcaacattttatcccttatttaaatacaaatttttaaagtaaaattgaggtctagaatagattagaaaataaaaataacaatttagataaatagaaatgtctgtcttagttttatataatatattaaaacacagtaaataaatttattggcattttctttctcctaaaacttacctagtgtgaacttaaaataaaggtaaaatgctgcctgaaaataatgtccaagcacctttgactaggataacattttcactacttgtgtgacactgtgtgttgcacgaagtaggatttgggtatacagtaaatgcttctaaaaggcattgtgcatattgacataaccaataatctgaaccgtgttcagcaaacttaattcaggaaagtggtattctacacaattattgctgttgtgtttgaaatgagtgtggcactcatctgtatccagaaataatatgggtgaggccacacaacccattctgagtggtgtctgtctgaaagcaaccctactcgcatgtgaaattgttctccttgatttggtcactataaagcaagtttaaatgtagaggctaactcagtgccaaaaacagggttacaaatgtgtagtatcttttattttagtcatattctaagacttctttttagtatgaaatcacttttaaattatacatgtaggttttgcttccattttcttcattttaccattttaattatttgaacattcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttttattcttggtattttcaaagaattattttgatatttttaatagaatgtgtaattttaaaatacacaaaaaacttaaagtagtattgattatacaaataattatttaacatgtcttatggatgtatctatatgtatatagacagtaatatatttataaaacaaatatactttgcttatgttatagctcttagtttgtgacaggtgggaggatggctctgggtgtgtgtgtgtgtgtgtgtgtgtgtgtgtgtgtgtgtgtgttttgaaaactctcaagctgttttccctctgatttacaatggtatttactttaaagtatgtttggttttcattattctttttgctctccaacttccttattcaagataaaataagacatacagttttctggccattctgttggtgtgtggtgcacccattttattgtcatctaactcctggagaattcccacgtgacctgaaatcaaacagattctggctggacatatgcttatgttccaaatatattaaagatgttaattcagctaacagttaagtttccaaggtatacaccaacaaataaaatgaggtattaaaaagagatggattacacacatgcattagaataagagaaaacagtagtgttaataaaagtaaagaaacatacactatcttagccccctagggcaggggttgactttttctgtaaaggatcagatagtaaataatacaggaatcatatggacttcaaatgccattgtaaaaactactcagctctgcctttagagcataagaacagccacagataacatgtaaattagtgtggctgtgttccaataaaactttatttacagaaacgggaagccggtcagattgggcctgtgggccataatttgctgatctcaagcagtaaatcctggtatatgttaatagaagaaatcataattgcatttcagttgacattaaaagaaaatctggtagtttttgatgtccttcaaaagaggattgttagacattgatgttaaagcatcttaattcatttgagttttcttacctgtttacacccattatttattagagatatttcttgtgtttaaccacaaaaaaaagcactctgttaaaatgttttaatatgtattgaatttctttcataaacttttcatttctgttgataaatgggaatcccttaccaaccttttgttttttaaaagtctcatagaccaaaaaaaatctgttgcagcatttaattagccacagatacattttggctgcatttaccagttacatttttccattggttttggcttctaataaataacatatctgccattctttaaaaatgattttaaagaagataaatatattgtaatttcacatgctatagctttattctgtaagattaaaaattgtgactagtataattgtagctataatgtgagtggcatgttacaatgtaactctttatgagaaataaaatgtatctctgctttgtctgtccagatctttaggatttttagatgccttgggactgtccttggtgaatgatattcttcatatgatcatatgtaattttgaattcgttggaagtacacgctgctgagcatgtttattcacagtgctttataccgggtgttgcatcagtaatcattttcataagaacatttaaacagcatgaacatcatcatccacttaaatagttaaactttcttttaaaattggaatgcaactgtaggttttaacaatgtttattgttttttaagtggttactttgtttttccttaatactttctgttaacttaattattactcctgttgcagtgttactgttatgtattagaagtggcttttccccctaagatccttagtcttttaaagacaatttaaggtattggccatttggcagtagaaaatgtgcatgttttaacttggttttataaaatctgtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccaggttattgattttatcttttcctttcagggttttgtcctcccaaaccagagtcatatgctgctagtagaattttttatttgatcctgcgaacttttcttataggaaaagtaaggcaaaggatgtgtagtgcaaccatctgataaactagtgtgattgtatttatcctctgttctgtgtatttctgtaatggaatctttacaattcccaaaacggtattttagacctactggaaatctgtatcgaaacagctatgtgattctgccactgagaaaaaaaaaatttttaattcgtttttcttatgctggtttgtttttctttaatgaagaaattgatctcatatggcatcatagatgctaaataaataaaagcatcatacttctctagtttgcctgcattcagtggctaacattatgagcattgtgtaagataaacacatggtcagtatcaatgtaaatgttagagccatgattaattcctatgaaaattgaaattaaatgtcaaagacaact

SEQ ID NO: 12870 - DNA, 9530 bp, Homo sapiens
agatagaataaaacttttaccttttcctggaatgaaatagactgttgtttccctggcacttaataaggatagcataatgctagaaattatattgtgttactatgttccatagtcaaaaaatcatgattactagggcaaaaccctgttcatctcttaagaagaatttaactcactttgtaattatttaattcccttctgtctatcttagaatatgtgctctttcattgcagtatctatgttatttttgaaagttctttagattgctcttaagcttcatccagattaataatgatttttcaagtataagttaatggtttctttctatgtggctttctttttaaaagaatatttatagatacttatgaattctgttagagaaaaatgtaaattttaacctgtcatgcatattaaaaacatactttttgatgatattctatgtgtcactctagaattataagccgtcctaaaagtagaaaaatctgatccatcgagattgagaaggagcatgatatagtgggaaaagcatgggttttagaatcagacgaaactgggtaaaaaaatacagttctactacttatttactttgttgccttggaggaattacatggcctttctaatttatgacttcttcatctgaaaaatggcagatgatactctcttggcaagggtgttaggagggaggagaggatgtagacaaaatacaaagtattttgagtagttgagtaattctcttctgacttctccattgagacagaaatctagccataactatgaaattctaaatattttacatttttctctaggaatacggggtgctttgcattcaggaatacagaaaaaacagcaaagtggagtcaagtacacgtaacaacttcatgggcttgaaggatcacctagggcatgacctcggccacctttatgtggagagcactgacccacagttaagtccagctgtaccttggtcaacagtagaaaacccaagtatggataccgttaatgtggggaaggatgaaaaagaggcgtctgaagagaatgcaagctctggtgactctgaagaaaacacaaattctgatcatgagtcagaacaattgggtagcatttcagtagagccaggcttgataactaagactcacagacagctctgcaggtctccctgtttagagcctcacatactcaagcgcaatgaaattttgcaagactttaaacctgaagagtcccagactacatccaaggaagcaaagaaaccacctgatgtggtgcgagaataccaaacaaaactggagtttgcacttaagttaggttattctgaagaacaggttcagcttgtactaaacaaacttggtactgatgctttaatcaatgatattttgggagaacttgtcaaacttggaaataaaagtgaggctgatcaaacggttagtacaattaacactataacacgggaaacttcttccctggaatctcagaggtctgaatctccaatgcaagagattgtaacagatgatggtgaaaatctgagaccaatagttattgatggcagcaatgtggcaatgagccatggaaacaaagaagtattttcctgcagaggaataaaattggcagtggattggtttttggaaagaggccacaaagacattacagtttttgttcctgcttggaggaaagagcaatcccgacctgatgctctcattacagatcaggaaattttacgtaaattagagaaggagaaaatcctggtgttcacgccatcccggcgagtccaggggaggagagtggtgtgctatgacgacaggttcatcgtgaagctggcttttgagtcggacggtatcattgtgtccaatgataactacagggacttggctaatgagaagccagaatggaagaagttcatagatgaacgattattaatgtattcatttgtcaatgacaagttcatgccccctgatgaccctcttggcagacatggccccagtctggataattttctgaggaagaaacctattgttcctgaacacaaaaagcagccttgtccatatggaaagaagtgtacctatggacacaagtgcaaatattaccatcccgaaaggggcagtcagccacagcggtcagtggctgatgaactccgtgccatgtctagaaatacggcagccaaaactgcaaacgaaggaggactggtgaaaagcaacagtgttccttgtagcaccaaggctgatagcacttctgatgtcaaacgaggtgctccaaagaggcaatcagatccaagcataaggacacaagtctaccaagacctagaagaaaagcttcccaccaaaaacaaattggaaaccaggtctgtaccttccttagttagcatcccagctacttctactgcaaaaccccaaagcactacatctttaagcaatggccttccatctggagttcatttcccacctcaggatcaaagaccacagggacaatatccttcaatgatgatggcaaccaaaaatcatggaacgccaatgccttatgaacagtatccaaaatgtgactcacctgtcgacatcggatattattccatgttgaatgcatactcaaatctgagtctctcaggcccacgaagccctgaaaggcgtttctccttagacacagattatagaataagttccgtagcttctgactgcagcagtgaagggagcatgagctgtgggagcagtgactcctacgtgggttacaatgaccggtcctatgtcagctcccccgacccacagctagaggagaatttgaagtgtcaacacatgcaccctcacagccgccttaatcctcaaccgttcctgcagaatttccacgaccccttaaccagagggcaaagttacagtcacgaagaaccaaagttccatcacaagcctcctcttccgcacctggctctgcacctgccgcactccgctgtgggcgcccggtccagctgtcctggcgactacccctctcctccaagttcagcacactctaaggcaccacacctagggaggtccttggtggccacgagaatagacagcatctctgactctcgactttatgacagttctccttcacgacaaagaaagccttattcccgccaggaaggcctgggaagctgggagaggccaggctatgggatcgacgcctatgggtaccggcagacttattccttgcccgataactccacacagccgtgttatgagcagttcaccttccagagcctccctgagcaacaggagccagcctggcggatcccatactgtggaatgccgcaagatcccccgaggtatcaagacaaccgagaaaagatttatatcaatttgtgcaacatcttcccccctgaccttgtgagaattgtcatgaaaaggaatcctcacatgacagacgcccagcagctcgccgcagccattttagtggagaaatcccagctgggttattgaaagatgatgcatctttgtggtgtttagtagttttttgttcagctcaaatgctgagggaggtttgctacaatagcacatgtgatctccttctcagcaaggaggttatatagtatccatttatgtgaaatactgtatcatggaatctgtatgtatagccccacatggtggaagtatcacgggattgctttacatttaaactttttttttttaacatttcctttttaaagctatatccttggctggaaatttttccagtttgatttaatagatgtatctgtgatctttgatattaatctttggtgcatcaggggtttatatgcagcactttttatccttgttttgtgttttattaacttggtgtttgtctatcaattgcaagcaattacaataccttcagaatgtgggacatttgactagacctagcaaactgttttttcgagccaagcttagttagactcttttacagctttttaagttatttttatttggggaaagtgggcttctttgtgctataatcattatttatagaaacaaagttatactacagcactgactttatattttaaacagaatgtaagttaccagttttatgttgaaatgtgttacagtatatatatattagaatgatttacaatatggcacttttcgatgtgttatttttgtttggatttttttttctgttaagaaattagttaatttaatatggtcaatttaaaagaaagcagatgcaatcaatggaaaaatgtttccattttttaaaaatgaataaggcaaaagctgtaactgttacaggttagagctttgttatccagctatgatgtgcttcttgacagtagaagtggaattgaattcctagatttccattaacctgtatttttaatatgtctgtctttttgttttggggcacaacaatactggataaaataaccctttcacagcacttgcctgtttttaatgaatctaattattcacaatgcaacttttatatttaacatactctttagctttcctgctatttatcaaggctggcctgaggtgggtttatgtgttgaggttatgcaacatttcttgatactgcactatagagaaatggtgatggaggagttgtaaatggtaacttaaaatttttgtaagatattgtatattttccattttcctgaaggtagttttcttgggggggcctgttatattattaaggccagactcttgccacaaatagtgtagttttagatacagactaaggtctgttctagtattagtaagggatatttctggtttcaaagtcatgggttttgctagtggtgaatacatttctgcggagtagaagatagattttgcagtcagtggcagacagttgtgtgattgacatcacttgactgttgcgtccaggttttgaattgtacttcacgtaacagatgcattcagatctttttctgtagtctgcttagatgccctggctattctgattatcctacatgctacagtttgaagtgaagccctgaaaaaccagaaagtaccttttactgttgatacaaattgtatctttttaactataagaactattttgatttgtagatctagttaaaacacaagtatgtaactatgattagacttttgggcaacattttatcccttatttaaatacaaatttttaaagtaaaattgaggtctagaatagattagaaaataaaaataacaatttagataaatagaaatgtctgtcttagttttatataatatattaaaacacagtaaataaatttattggcattttctttctcctaaaacttacctagtgtgaacttaaaataaaggtaaaatgctgcctgaaaataatgtccaagcacctttgactaggataacattttcactacttgtgtgacactgtgtgttgcacgaagtaggatttgggtatacagtaaatgcttctaaaaggcattgtgcatattgacataaccaataatctgaaccgtgttcagcaaacttaattcaggaaagtggtattctacacaattattgctgttgtgtttgaaatgagtgtggcactcatctgtatccagaaataatatgggtgaggccacacaacccattctgagtggtgtctgtctgaaagcaaccctactcgcatgtgaaattgttctccttgatttggtcactataaagcaagtttaaatgtagaggctaactcagtgccaaaaacagggttacaaatgtgtagtatcttttattttagtcatattctaagacttctttttagtatgaaatcacttttaaattatacatgtaggttttgcttccattttcttcattttaccattttaattatttgaacattcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttttattcttggtattttcaaagaattattttgatatttttaatagaatgtgtaattttaaaatacacaaaaaacttaaagtagtattgattatacaaataattatttaacatgtcttatggatgtatctatatgtatatagacagtaatatatttataaaacaaatatactttgcttatgttatagctcttagtttgtgacaggtgggaggatggctctgggtgtgtgtgtgtgtgtgtgtgtgtgtgtgtgtgtgtgtgtgttttgaaaactctcaagctgttttccctctgatttacaatggtatttactttaaagtatgtttggttttcattattctttttgctctccaacttccttattcaagataaaataagacatacagttttctggccattctgttggtgtgtggtgcacccattttattgtcatctaactcctggagaattcccacgtgacctgaaatcaaacagattctggctggacatatgcttatgttccaaatatattaaagatgttaattcagctaacagttaagtttccaaggtatacaccaacaaataaaatgaggtattaaaaagagatggattacacacatgcattagaataagagaaaacagtagtgttaataaaagtaaagaaacatacactatcttagccccctagggcaggggttgactttttctgtaaaggatcagatagtaaataatacaggaatcatatggacttcaaatgccattgtaaaaactactcagctctgcctttagagcataagaacagccacagataacatgtaaattagtgtggctgtgttccaataaaactttatttacagaaacgggaagccggtcagattgggcctgtgggccataatttgctgatctcaagcagtaaatcctggtatatgttaatagaagaaatcataattgcatttcagttgacattaaaagaaaatctggtagtttttgatgtccttcaaaagaggattgttagacattgatgttaaagcatcttaattcatttgagttttcttacctgtttacacccattatttattagagatatttcttgtgtttaaccacaaaaaaaagcactctgttaaaatgttttaatatgtattgaatttctttcataaacttttcatttctgttgataaatgggaatcccttaccaaccttttgttttttaaaagtctcatagaccaaaaaaaatctgttgcagcatttaattagccacagatacattttggctgcatttaccagttacatttttccattggttttggcttctaataaataacatatctgccattctttaaaaatgattttaaagaagataaatatattgtaatttcacatgctatagctttattctgtaagattaaaaattgtgactagtataattgtagctataatgtgagtggcatgttacaatgtaactctttatgagaaataaaatgtatctctgctttgtctgtccagatctttaggatttttagatgccttgggactgtccttggtgaatgatattcttcatatgatcatatgtaattttgaattcgttggaagtacacgctgctgagcatgtttattcacagtgctttataccgggtgttgcatcagtaatcattttcataagaacatttaaacagcatgaacatcatcatccacttaaatagttaaactttcttttaaaattggaatgcaactgtaggttttaacaatgtttattgttttttaagtggttactttgtttttccttaatactttctgttaacttaattattactcctgttgcagtgttactgttatgtattagaagtggcttttccccctaagatccttagtcttttaaagacaatttaaggtattggccatttggcagtagaaaatgtgcatgttttaacttggttttataaaatctgtaatgtttcacttcttgaaccatgtaccaaatttgccaattttctgtccaagtgtttcagatgaataacaaaacgctgttcattgaagctttcgccacctttcttaaagcagcgtatgttccaagggaaaaaggcattgaaaagcaatcgtttgtttttatgaagaataggtgttcagattccttcagtttttttgaaattagaaatttcttaccttatgtgaaatattcacaaacgtgcacacttctgcagagacaaagcatttcactgcacgtgtaccaggttattgattttatcttttcctttcagggttttgtcctcccaaaccagagtcatatgctgctagtagaattttttatttgatcctgcgaacttttcttataggaaaagtaaggcaaaggatgtgtagtgcaaccatctgataaactagtgtgattgtatttatcctctgttctgtgtatttctgtaatggaatctttacaattcccaaaacggtattttagacctactggaaatctgtatcgaaacagctatgtgattctgccactgagaaaaaaaaaatttttaattcgtttttcttatgctggtttgtttttctttaatgaagaaattgatctcatatggcatcatagatgctaaataaataaaagcatcatacttctctagtttgcctgcattcagtggctaacattatgagcattgtgtaagataaacacatggtcagtatcaatgtaaatgttagagccatgattaattcctatgaaaattgaaattaaatgtcaaagacaact

SEQ ID NO: 12871 - DNA, 1514 bp, Homo sapiens
cggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaaaaaaaaaaaaaaaaaaaaaaaaaaaaaaaaaaaaaaaaaaaaaaaaaaaaaaaaaaa

SEQ ID NO: 12872 - DNA, 3105 bp, Homo sapiens
cggtgccaggtgggctacgcggctggggcggctgcggatatcgccttagggacgcgttgacattcactggctagtccaccgctctcagtcggagaccacattgcctcgtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactgttaaaaaaaaaa

SEQ ID NO: 12873 - DNA, 2394 bp, Homo sapiens
cgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagagatgggatttcaccatgctactcaggcttgtcttgaactcctgggctcaagcgatctgcctgcctcagcctcccaaagtgctgggattacaggtgtgaaccaccgtgcccagccaggcctcaatgtttctgtggacaaattcactgcactgtgctcacctggggtgctgcaaactgtgaaatggtttttagagttcagatgcatcttctcactagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagccttcatgtggttctcagacattaccaaacataagcaaacccatactggagagaaaccctacaaatgtgacgaatgtggcaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaatggaaaaataagcaaaatccaatttaagtaaacaatggaggatttgaaggagaaaggaatagagcacggacacgttcagaaatgacactgaatccctgtgttgagtctacagagacatctaga

SEQ ID NO: 12874 - DNA, 4883 bp, Homo sapiens
caattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgc

SEQ ID NO: 12875 - DNA, 4627 bp, Homo sapiens
tcacggtctttaccgctcagcttcccggagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggaggtgagaaaacacttctacatggtaagcatgaacgtacgcatactaaaactagattttctgaaaatgcaaaatgtatccatactaaattccaagtcttcaagcatcagaggactcagaaaattgagaaaccccatgcatgcattgaatgtgagcaaaccttccttaggaagtctcagctcatttaccatgagaacatttgtatacaagagaatcctggaagtggtcaatgtgagaaattatccagaagtgtcctgttcactaagcatctgaaaactaatacaacagacaaaatctgtatacccaatgaatatagaaaaggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaactaagattatagagatgatcagtttataaaaccaccttcaacttaaataaatttgaactcgaaattgcaaaagcagtctagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatctaaaaaaaaaaaaaaaaaa

SEQ ID NO: 12876 - DNA, 4900 bp, Homo sapiens
atggaggagttgtcctctggccaagctggtcaggactacctggtgggcactggtggtggaaggcagtttgcagttgatagtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaa

SEQ ID NO: 12877 - DNA, 4901 bp, Homo sapiens
atggaggagttgtcctctggccaagctggtcaggactacctggtgggcactggtggtggaaggcagtttgcagttgatagtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaa

SEQ ID NO: 12878 - protein, 1280 aa, Homo sapiens
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 12879 - protein, 1101 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 12880 - protein, 1091 aa, Homo sapiens
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 12881 - protein, 1194 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 12882 - protein, 1237 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 12883 - protein, 1248 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 12884 - protein, 1205 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 12885 - protein, 338 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKVVERCHWGILTDLLHKWNQS

SEQ ID NO: 12886 - protein, 475 aa, Homo sapiens
MAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICKILTTDSDREKDHIFSSYTAFGDLEVFLHGLGLEHMTDLLKERDITLRHLLTMREDEFTKNGITSKDQQKILAALKELQVEEIQFGELSEETKLEISGDEFLNFLLKLNKQCGHLITAVQNVITELPVNSQKITLEWASPQNFTSVCEELVNNVEDLSEKVCKLKDLIQKLQNERENDPTHIQLREEVSTWNSRILKRTAITICGFGFLLFICKLTFQRK

SEQ ID NO: 12887 - protein, 670 aa, Homo sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 12888 - protein, 1465 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 12889 - protein, 1258 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIESKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 12890 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 12891 - protein, 475 aa, Homo sapiens
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 12892 - protein, 263 aa, Homo sapiens
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGAEEEAVQTPAGVESGAASEAPGGRGCDRPRADHAAPPQEAGVQCTCQHYTVREEAQKTPPADPACPEREDSHGSGSPFKASQD

SEQ ID NO: 12893 - protein, 706 aa, Homo sapiens
MKIFSESHKTVFVVDHCPYMAESCRQHVGFDMLVKNRTQGIIPLAPISKSLWPCSVESSMEYCRIMYDIFPFKKPVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRENRLTPFLDPRYKIDGSLEVPLERAKDQLEKHTRYRPMIISQTTIFNMQAVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 12894 - protein, 131 aa, Homo sapiens
MGGKSAVRHQLVLDCPREAASSAPALRPLGAAATSRAAPLAPLPAPSPRWGLGCGRVRYPGPHPRRAVEPAAGPLSAPIIAGGHPAEAAAGSAKQQPRHSREVPRPPVPQHPSGNSRSALQEAKTEQTKTP

SEQ ID NO: 12895 - protein, 1094 aa, Homo sapiens
MAESSSESDHFRCRDRLSPWAARSTHRGTRSLPTVEVTEKVNTITSTLQDTSRNLRQVDQMLGRYREYSNGQAGAIEHLKESLEQSIDQLRSQRLLRNSGGRSISVTSLSASDLDGGTGSELHHFPPTSPLKDYGDPQGIKRMRSRTGVRFVQETDDMTQLHGFHQSLRDLSSEQIRLGDDFNRELSRRSRSDAETKRALEELTEKLNEAQKQEVVSDRVERRLQELEREMRTERELVERRQDQLGLMSLQLQEALKKQEAKADEHEGAIKNKLRQTETEKNQLEQELELSRRLLNQSEGSRETLLHQVEELRTQLTKAEGDRKGLQHQVSQISKQQSNYQDEQGEDWRFRRGVEREKQDLEKQMSDLRVQLNFSAMASELEEVKRCMERKDKEKAHLASQVENLTRELENGEKQQLQMLDRLKEIQNHFDTCEAERKHADLQISELTRHAEDATKQAERYLSELQQSEALKEEAEKRREDLKLKAQESIRQWKLKHKKLERALEKQSETVDELTGKNNQILKEKDELKTQLYAALQQIENLRKELNDVLTKRALQEEELHSKEEKLRDIKSHQADLELEVKNSLDTIHRLESELKKQSKIQSQMKVEKAHLEEEIAELKKSQAQDKAKLLEMQESIKDLSAIRADLANKLAEEERAKKAVLKDLSDLTAQAKSRDEETATIITQLKLERDVHQRELKDLTSSLQSVKTKHEQNIQELMKHFKKEKSEAENHIRTLKAESLEEKNMAKIHRGQLEKLKSQCDRLTEELTQNENENKKLKLKYQCLKDQLEEREKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVPEKLSLLEDFKDFRDSCSSSERTDGRYSKYRVRRNSLQHHQDDTKYRTKSFKGDRTFLEGSHTRGLDHSSSWQDHSRFLSSPRFSYVNSFTKRTVAPDSASNKEDATMNGTSSQPKKEEYGS

SEQ ID NO: 12896 - protein, 400 aa, Homo sapiens
MAEKILEKLDVLDKQAEIILARRTKINRLQSEGRKTTMAIPLTFDFQLEFEEALATSASKAISKIKEDKSCSITKSKMHVSFKCEPEPRKSNFEKSNLRPFFIQTNVKNKESESTAQIEKKPRKPLDSVGLLEGDRNKRKKSPQMNDFNIKENKSVRNYQLSKYRSVRKKSLLPLCFEDELKNPHAKIVNVSPTKTVTSHMEQKDTNPIIFHDTEYVRMLLLTKNRFSSHPLENENIYPHKRTNFILERNCEILKSIIGNQSISLFKPQKTMPTVQRKDIQIPMSFKAGHTTVDDKLKKKTNKQTLENRSWNTLYNFSQNFSSLTKQFVGYLDKAVIHEMSAQTGKFERMFSAGKPTSIPTSSALPVKCYSKPFKYIYELNNVTPLDNLLNLSNEILNAS

SEQ ID NO: 12897 - protein, 578 aa, Homo sapiens
MGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 12898 - protein, 581 aa, Homo sapiens
MAFLTTWKEAASGKSDRRTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 12899 - protein, 153 aa, Homo sapiens
MYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 12900 - protein, 221 aa, Homo sapiens
MKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 12901 - protein, 378 aa, Homo sapiens
MLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 12902 - protein, 577 aa, Homo sapiens
MTSAGGAPGALPAGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 12903 - protein, 581 aa, Homo sapiens; identical to SEQ ID NO: 12898

SEQ ID NO: 12904 - protein, 578 aa, Homo sapiens; identical to SEQ ID NO: 12897

SEQ ID NO: 12905 - protein, 153 aa, Homo sapiens; identical to SEQ ID NO: 12899

SEQ ID NO: 12906 - protein, 221 aa, Homo sapiens; identical to SEQ ID NO: 12900

SEQ ID NO: 12907 - protein, 378 aa, Homo sapiens; identical to SEQ ID NO: 12901

SEQ ID NO: 12908 - protein, 577 aa, Homo sapiens; identical to SEQ ID NO: 12902

SEQ ID NO: 12909 - protein, 199 aa, Homo sapiens
MEDAAAPGRTEGVLERQGAPPAAGQGGALVELTPTPGGLALVSPYHTHRAGDPLDLVALAEQVQKADEFIRANATNKLTVIAEQIQHLQEQARKVLEDAHRDANLHHVACNIVKKPGNIYYLYKRESGQQYFSIISPKEWGTSCPHDFLGAYKLQHDLSWTPYEDIEKQDAKISMMDMLLSQSVALPPCTEPNFQGLTH

SEQ ID NO: 12910 - protein, 316 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLKKSVIYSSLKLHKMWKGWLRKTS

SEQ ID NO: 12911 - protein, 805 aa, Homo sapiens
MWDQGGQPWQQWPLNQQQWMQSFQHQQDPSQIDWAALAQAWIAQREASGQQSMVEQPPGMMPNGQDMSTMESGPNNHGNFQGDSNFNRMWQPEWGMHQQPPHPPPDQPWMPPTPGPMDIVPPSEDSNSQDSGEFAPDNRHIFNQNNHNFGGPPDNFAVGPVNQFDYQHGAAFGPPQGGFHPPYWQPGPPGPPAPPQNRRERPSSFRDRQRSPIALPVKQEPPQIDAVKRRTLPAWIREGLEKMEREKQKKLEKERMEQQRSQLSKKEKKATEDAEGGDGPRLPQRSKFDSDEEEEDTENVEAASSGKVTRSPSPVPQEEHSDPEMTEEEKEYQMMLLTKMLLTEILLDVTDEEIYYVAKDAHRKATKAPAKQLAQSSALASLTGLGGLGGYGSGDSEDERSDRGSESSDTDDEELRHRIRQKQEAFWRKEKEQQLLHDKQMEEEKQQTERVTKEMNEFIHKEQNSLSLLEAREADGDVVNEKKRTPNETTSVLEPKKEHKEKEKQGRSRSGSSSSGSPSSNSRTSSTSSTVSSSSYSSSSGSSRTSSRSSSPKRKKRHSRSRSPTIKARRSRSRSYSRRIKIESNRARVKIRDRRRSNRNSIERERRRNRSPSRERRRSRSRSRDRRTNRASRSRSRDRRKIDDQRGNLSGNSHKHKGEAKEQERKKERSRSIDKDRKKKDKEREREQDKRKEKQKREEKDFKFSSQDDRLKRKRESERTFSRSGSISVKIIRHDSRQDSKKSTTKDSKKHSGSDSSGRSSSESPGSSKEKKAKKPKHSRSRSAEKSQRSGKKASRKHKSKSRSR

SEQ ID NO: 12912 - protein, 101 aa, Homo sapiens
MHLHVQPLRAKGKRPKDTFNKMAHRKRHSVTSEFLSKVPDEVRQRYINLFVEKYLKVCKTEDEAVYKAKIEKKAIYERCSRRNMYVNIAVNYLKKLRDQGA

SEQ ID NO: 12913 - protein, 101 aa, Homo sapiens
MHLHVQTLRAKGKRPKDTFNKMAHRKRHSVTSEFLSKVPDEVRQRYINLFVEKYLKVCKTEDEAVYKAKIEKKAIYERCSRRNMYVNIAVNYLKKLRDQGA

SEQ ID NO: 12914 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 12915 - protein, 357 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCAYVAKPESLS

SEQ ID NO: 12916 - protein, 385 aa, Homo sapiens
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 12917 - protein, 1105 aa, Homo sapiens
MTSSDKDFRFMATSDLMSELQKDSIQLDEDSERKVVKMLLRLLEDKNGEVQNLAVKWLGVPLGAFHASLLHCLLPQLSSPRLAVRKRAVGALGHLAAACSTDLFVELADHLLDRLPGPRVPTSPTAIRTLIQCLGSVGRQAGHRLGAHLDRLVPLVEDFCNLDDDELRESCLQAFEAFLRKCPKEMGPHVPNVTSLCLQYIKHDPNYNYDSDEDEEQMETEDSEFSEQESEDEYSDDDDMSWKVRRAAAKCIAALISSRPDLLPDFHCTLAPVLIRRFKEREENVKADVFTAYIVLLRQTQPPKGWLEAMEEPTQTGSNLHMLRGQVPLVVKALQRQLKDRSVRARQGCFSLLTELAGVLPGSLAEHMPVLVSGIIFSLADRSSSSTIRMDALAFLQGLLGTEPAEAFHPHLPILLPPVMACVADSFYKIAAEALVVLQELVRALWPLHRPRMLDPEPYVGEMSAVTLARLRATDLDQEVKERAISCMGHLVGHLGDRLGDDLEPTLLLLLDRLRNEITRLPAIKALTLVAVSPLQLDLQPILAEALHILASFLRKNQRALRLATLAALDALAQSQGLSLPPSAVQAVLAELPALVNESDMHVAQLAVDFLATVTQAQPASLVEVSGPVLSELLRLLRSPLLPAGVLAAAEGFLQALVGTRPPCVDYAKLISLLTAPVYEQAVDGGPGLHKQVFHSLARCVAALSAACPQEAASTASRLVCDARSPHSSTGVKVLAFLSLAEVGQVAGPGHQRELKAVLLEALGSPSEDVRAAASYALGRVGAGSLPDFLPFLLEQIEAEPRRQYLLLHSLREALGAAQPDSLKPYAEDIWALLFQRCEGAEEGTRGVVAECIGKLVLVNPSFLLPRLRKQLAAGRPHTRSTVITAVKFLISDQPHPIDPLLKSFIAVHNKPSLVRDLLDDILPLLYQETKIRRDLIREVEMGPFKHTVDDGLDVRKAAFECMYSLLESCLGQLDICEFLNHVEDGLKDHYDIRMLTFIMVARLATLCPAPVLQRVDRLIEPLRATCTAKVKAGSVKQEFEKQDELKRSAMRAVAALLTIPEVGKSPIMADFSSQIRSNPELAALFESIQKDSASAPSTDSMELS

SEQ ID NO: 12918 - protein, 110 aa, Homo sapiens
MSTAAFHISSLLEKMTSSDKDFRFMATSDLMSELQKDSIQLDEDSERKVVKMLLRLLEDKNGEVQNLAVKCCRAPLLQGPLSCHNPGKEAGREWGEGRSLAQVARGVRSA

SEQ ID NO: 12919 - protein, 1105 aa, Homo sapiens; identical to SEQ ID NO: 12917

SEQ ID NO: 12920 - protein, 110 aa, Homo sapiens; identical to SEQ ID NO: 12918

SEQ ID NO: 12921 - protein, 507 aa, Homo sapiens
MMGHRPVLVLSQNTKRESGRKVQSGNINAAKIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 12922 - protein, 544 aa, Homo sapiens
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 12923 - protein, 545 aa, Homo sapiens
MMGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 12924 - protein, 166 aa, Homo sapiens
MASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 12925 - protein, 166 aa, Homo sapiens; identical to SEQ ID NO: 12924

SEQ ID NO: 12926 - protein, 623 aa, Homo sapiens
MERPEEGKQSPPPQPWGRLLRLGAEEGEPHVLLRKREWTIGRRRGCDLSFPSNKLVSGDHCRIVVDEKSGQVTLEDTSTSGTVINKLKVVKKQTCPLQTGDVIYLVYRKNEPEHNVAYLYESLSEKQGMTQESFEMVPCCVAQAGLKLLGSSDPPTLASQSIVITGSGGGGISPKGSGPSVASDEVSSFASALPDRKTASFSSLEPQDQEDLEPEKKKMRGDGDLDLNGQLLVAQPRRNAQTVHEDVRAAAGKPDKMEETLTCIICQDLLHDCVSLQPCMHTFCAACYSGWMERSSLCPTCRCPVERICKNHILNNLVEAYLIQHPDKSRSEEDVQSMDARNKITQDMLQPKVRRSFSDEEGSSEDLLELSDVDSESSDISQPYVVCRQCPEYRRQAAQPPHCPAPEGEPGAPQALGDAPPTSVSLTTAVQDYVCPLQGSHALCTCCFQPMPDRRAEREQDPRVAPQQCAVCLQPFCHLYWGCTRTGCYGCLAPFCELNLGDKCLDGVLNNNSYESDILKNYLATRGLTWKNMLTESLVALQRGVFLLSDYRVTGDTVLCYCCGLRSFRELTYQYQQNIPASELPVAVTSRPDCYWGRNCRTQVKAHHAMKFNHICEQTRFKN

SEQ ID NO: 12927 - protein, 228 aa, Homo sapiens
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 12928 - protein, 1401 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLEFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSSGSRYQPLASTASDNDFVTPEPRRTTRRHPNTQQRASKKKPKVVFSSDESSEEDLSAEMTEDETPKKTTPILRASARRHRS

SEQ ID NO: 12929 - protein, 217 aa, Homo sapiens
MSWTCPRCQQPVFFAEKVSSLGKNWHRFCLKCERCHSILSPGGHAEHNGRPYCHKPCYGALFGPRGVNIGGVGSYLYNPPTPSPGCTTPLSPSSFSPPRPRTGLPQGKKSPPHMKTFTGETSLCPGCGEPVYFAEKVMSLSRNWHRPRLRCQRCHKTLTAGSHAEHDGVPYCHVPCYGYLFGPKGGQPHPRHWDGMYMPEVWHVHGLWVCVDNFPCG

SEQ ID NO: 12930 - protein, 175 aa, Homo sapiens
MGKITFYEDRAFQGRSYECTTDCPNLQPYFSRCNSIRVESGCWMIYERPNYQGHQYFLRRGEYPDYQQWMGLSDSIRSCCLIPPHSGAYRMKIYDRDELRGQMSELTDDCLSVQDRFHLTEIHSLNVLEGSWILYEMPNYRGRQYLLRPGEYRRFLDWGAPNAKVGSLRRVMDLY

SEQ ID NO: 12931 - protein, 98 aa, Homo sapiens
MMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 12932 - protein, 532 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNNPAENSPNHRPYTASDFIEGIYRTERDKGTLYELTFKGDHKHEFKRLILFRPFSPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 12933 - protein, 304 aa, Homo sapiens
MGQCVTKCKNPSSTLGSKNGDREPSNKSHSRRGAGHREEQVPPCGKPGGDILVNGTKKAEAATEACQLPTSSGDAGRESKSNAEESSLQRLEELFRRYKDEREDAILEEGMERFCNDLCVDPTEFRVLLLAWKFQAATMCKFTRKEFFDGCKAISADSIDGICARFPSLLTEAKQEDKFKDLYRFTFQFGLDSEEGQRSLHREIAIALWKLVFTQNNPPVLDQWLNFLTENPSGIKGISRDTWNMFLNFTQVIGPDLSNYSEDEAWPSLFDTFVEWEMERRKREGEGRGALSSGPEGLCPEEQT

SEQ ID NO: 12934 - protein, 1556 aa, Homo sapiens
MADRSLEGMALPLEVRARLAELELELSEGDITQKGYEKKRSKLIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 12935 - protein, 472 aa, Homo sapiens
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 12936 - protein, 261 aa, Homo sapiens
MESMFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 12937 - protein, 489 aa, Homo sapiens
MESMFSSPAEAALQRETGVPGLLTPLPDLDGVYELERVAGFVRDLGCERVALQFPDQLLGDAVAVAARLEETTGSKMFILGDTAYGSCCVDVLGAEQAGAQALIHFGPACLSPPARPLPVAFVLRQRSVALELCVKAFEAQNPDPKAPVVLLSEPACAHALEALATLLRPRYLDLLVSSPAFPQPVGSLSPEPMPLERFGRRFPLAPGRRLEEYGAFYVGGSKASPDPDLDPDLSRLLLGWAPGQPFSSCCPDTGKTQDEGARAGRLRARRRYLVERARDARVVGLLAGTLGVAQHREALAHLRNLTQAAGKRSYVLALGRPTPAKLANFPEVDVFVLLACPLGALAPQLSGSFFQPILAPCELEAACNPAWPPPGLAPHLTHYADLLPGSPFHVALPPPESELWETPDVSLITGDLRPPPAWKSSNDHGSLALTPRPQLELAESSPAASFLSSRSWQGLEPRLGQTPVTEAVSGRRGIAIAYEDEGSG

SEQ ID NO: 12938 - protein, 176 aa, Homo sapiens
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 12939 - protein, 585 aa, Homo sapiens
MAPSTPLLTVRGSEGLYMVNGPPHFTESTVFPRESGKNCKVCIFSKDGTLFAWGNGEKVNIISVTNKGLLHSFDLLKAVCLEFSPKNTVLATWQPYTTSKDGTAGIPNLQLYDVKTGTCLKSFIQKKMQNWCPSWSEDETLCARNVNNEVHFFENNNFNTIANKLHLQKINDFVLSPGPQPYKVAVYVPGSKGAPSFVRLYQYPNFAGPHAALANKSFFKADKVTMLWNKKATAVLVIASTDVDKTGASYYGEQTLHYIATNGESAVVQLPKNGPIYDVVWNSSSTEFCAVYGFMPAKATIFNLKCDPVFDFGTGPRNAAYYSPHGHILVLAGFGNLRGQMEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRNKPITNSKLHEEEPPQNMKPQSGNDKPLSKTALKNQRKHEAKKAAKQEARSDKSPDLAPTPAPQSTPRNTVSQSISGDPEIDKKIKNLKKKLKAIEQLKEQAATGKQLEKNQLEKIQKETALLQELEDLELGI

SEQ ID NO: 12940 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 12941 - protein, 385 aa, Homo sapiens
MSLILNILREMLEYFGVPVEQVLLIWENKDYGSTRSIVRIIGKMLPLEPCRRPNFELIPLLNSVDSDNCGSMVPSFADILYVANDEEASYLRFRNSIWKNEEEKVEIFHPLRLVRDPLSPAVRQKETVKNDLPVNEAAIRKIAALENELTFLRSQIAAIVEMQELKNSTNSSSFGLSDERISLGQLSSSRAAHLSVDPDQLPGSVLSPPPPPPLPPQFSSLQPPCFPPVQPGSNNICDSDNPATEMSKQNPAANKTNYSHHSKSQRNKDIPNMLDVLKDMNKVKLRAIERSPGGRPIHKRKRQNSHWDPVSLISHALKQKFAFQEDDSFEKENRSWESSPFSSPETSRFGHHISQSEGQRTKEEMVNTKAVDQGISNTSLLNSRI

SEQ ID NO: 12942 - protein, 542 aa, Homo sapiens
MEPDSVIEDKTIELMCSVPRSLWLGCANLVESMCALSCLQSMPSVRCLQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 12943 - protein, 529 aa, Homo sapiens
MEPDSVIEDKTIELMNTSVMEDQNEDESPKKNTLWQISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 12944 - protein, 508 aa, Homo sapiens
MEPDSVIEDKTIELMISNGTSSVIVSRKRPSEGNYQKEKDLCIKYFDQWSESDQVEFVEHLISRMCHYQHGHINSYLKPMLQRDFITALPEQGLDHIAENILSYLDARSLCAAELVCKEWQRVISEGMLWKKLIERMVRTDPLWKGLSERRGWDQYLFKNRPTDGPPNSFYRSLYPKIIQDIETIESNWRCGRHNLQRIQCRSENSKGVYCLQYDDEKIISGLRDNSIKIWDKTSLECLKVLTGHTGSVLCLQYDERVIVTGSSDSTVRVWDVNTGEVLNTLIHHNEAVLHLRFSNGLMVTCSKDRSIAVWDMASATDITLRRVLVGHRAAVNVVDFDDKYIVSASGDRTIKVWSTSTCEFVRTLNGHKRGIACLQYRDRLVVSGSSDNTIRLWDIECGACLRVLEGHEELVRCIRFDNKRIVSGAYDGKIKVWDLQAALDPRAPASTLCLRTLVEHSGRVFRLQFDEFQIISSSHDDTILIWDFLNVPPSAQNETRSPSRTYTYISR

SEQ ID NO: 12945 - protein, 216 aa, Homo sapiens
MGPRNPSPDHLSESESEEEENISYLNESSGEEWDSSEEEDSMVPNLSPLESLAWQVKCLLKYSTTWKPLNPNSWLYHAKLLDPSTPVHILREIGLRLSHCSHCVPKLEPIPEWPPLASCGVPPFQKPLTSPSRLSRDHATLNGALQFATKQLSRTLSRATPIPEYLKQIPNSCVSGCCCGRLTKTVKETTRTEPINTTYSYTDFQKAVNKLLTASL

SEQ ID NO: 12946 - protein, 615 aa, Homo sapiens
MAVYVGMLRLGRLCAGSSGVLGARAALSRSWQEARLQGVRFLSSREVDRMVSTPIGGLSYVQGCTKKHLNSKTVVQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 12947 - protein, 691 aa, Homo sapiens
MMRNHRIASSLCGDQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 12948 - protein, 842 aa, Homo sapiens
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 12949 - protein, 348 aa, Homo sapiens
MSAAFPPSLMMMQRPLGSSTAFSIDSLIGSPPQPSPGHFVYTGYPMFMPYRPVVLPPPPPPPPALPQAALQPALPPAHPHHQIPSLPTGFCSSLAQGMALTSTLMATLPGGFSASPQHQEAAAARKFAPQPLPGGGNFDKAEALQADAEDGKGFLAKEGSLLAFSAAETVQASLVGAVRGQGKDESKVEDDPKGKEESFSLESDVDYSSDDNLTGQAAHKEEDPGHALEETPPSSGAAGSTTSTGKNRRRRTAFTSEQLLELEKEFHCKKYLSLTERSQIAHALKLSEVQVKIWFQNRRAKWKRVKAGNANSKTGEPSRNPKIVVPIPVHVSRFAIRSQHQQLEQARP

SEQ ID NO: 12950 - protein, 339 aa, Homo sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSSVAEFSEATAELTVSFTNKVFTTETSRSITTSPKESDSPAGPARQYYTKGNLVRICLGAVILIILAGFLAEDWHSRRKRLRHRGRAVQRPLPPLPPLPQTRKSHGGQDGGRQDVHSRGLCS

SEQ ID NO: 12951 - protein, 709 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 12952 - protein, 694 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGNILWW

SEQ ID NO: 12953 - protein, 132 aa, Homo sapiens
MLLRMSEHRNEALGNYLEMRLKSSFLRGLGSWKSNPLRLGGWTILLTLTMGQGEPGGPQGDPWVPHELLLPSLCDSSHASSWGSGSITCAWRGGDSSSHPLVSGHILSNSPVAAVMCSSMGTHLSPFKGTLL

SEQ ID NO: 12954 - protein, 390 aa, Homo sapiens
MESETEPEPVTLLVKSPNQRHRDLELSGDRGWSVGHLKAHLSRVYPERPRPEDQRLIYSGKLLLDHQCLRDLLPKEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 12955 - protein, 366 aa, Homo sapiens
MESETEPEPVTLLVKSPNQRHRDLELSGDRGWSVGHLKAHLSRVYPERPRPEDQRLIYSGKLLLDHQCLRDLLPKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 12956 - protein, 391 aa, Homo sapiens
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 12957 - protein, 284 aa, Homo sapiens
MWRGLALARAIGCAARGRGQWAVRAADCAQSGRHPGPAVVCGRRLISVLEQIRHFVMMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 12958 - protein, 954 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSIGTREVVTQKNLSGLVPIRDLRLDPSLLCSIPLLALSPNLLIVWLFLSIAYLVTKLRCK

SEQ ID NO: 12959 - protein, 938 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKDCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 12960 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 12961 - protein, 676 aa, Homo sapiens [sequence omitted]

SEQ ID NO: 12962 - protein, 586 aa, Homo sapiens
MLRLPLRRIQEIKHTVTRVQSSVKRSSGYTPRGFSFDPGFLIVLVCLIFSVLSTIEQYAALATGTLFWMEIVLVVFFRTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 12963 - protein, 549 aa, Homo sapiens
MDFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 12964 - protein, 1049 aa, Homo sapiens
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 12965 - protein, 624 aa, Homo sapiens
MGRWLNKLAVDENNATNGEVPETSIRERAGRKCSREGGEGPGNQAALSPPPLQPELEEGEARKKMAAVAAEAAATAASPGEGGAGEAEPEMEPIPGSEAGTDPLPVTATEASVPDGETDGQQSAPQADEPPLPPPPPPPGELARSPEAVGPELEAEEKLSVRVAESAAAAPQGGPELPPSPASPPEQPPAPEEREEPPLPQPVAPALVPPAGGDSTVSQLIPGSEVRVTLDHIIEDALVVSFRFGEKLFSGVLMDLSKRFGPHGIPVTVFPKREYKDKPEAMPLQSNTFQEGTEVKCEANGAVPDDPSPVPHPELSLAESLWTSKPPPLFHEGAPYPPPLFIRDTYNQSIPQPPPRKIKRPKRKMYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGLNKWQLLHQTVTSPAAPLQCLTDHCGFRLGALKLTVKRAAQRH

SEQ ID NO: 12966 - protein, 624 aa, Homo sapiens; identical to SEQ ID NO: 12965

SEQ ID NO: 12967 - protein, 305 aa, Homo sapiens [sequence omitted]

SEQ ID NO: 12968 - protein, 305 aa, Homo sapiens [sequence omitted]

SEQ ID NO: 12969 - protein, 1077 aa, Homo sapiens
MPRRKQEQPKRLPSHVSRQEEAEGELSEGEHWYGNSSEAPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHARQLSVLARKLAEKQEQNDQYTPSNRFIWNQGKWLPNSTTTCSLSPDSAILKLKAAANAVLQDKSLTRTEETMRFESLSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFGTELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLK

SEQ ID NO: 12970 - protein, 94 aa, Homo sapiens
MARFSTVMVNFMCQFDWTMGCPAFLQKEMHSKNLHSQHKEIKPAPTDLHTCPCTCRKCSSKTGPFRRKLAYIREGMGFQACHLHSRSTHKTAKH

SEQ ID NO: 12971 - protein, 94 aa, Homo sapiens; identical to SEQ ID NO: 12970

SEQ ID NO: 12972 - protein, 281 aa, Homo sapiens
MAQQLCGIQLLKMVWNVKGPGGLPEWISILQGLRHPAATSTTTMRLQLILTALRGFHDQIQEQEAEELRLTNGPSGLFRGARFCPTPLRNGTREGRTRTGRGGQRRACAAGGAENSLRTRRSAGRTHAAQLPKLQTARRTAQCASSACSREKERKLRRGSVGFSTSDNHVFPDRRPEPCSFAIRRGLQRASSSIWAPLPRKSPAIPFRTGSLRGEFSSVDSDLLRLTSLGNPASRGTSAAGHTGFTPAPPHQQAHSQVVRLRMDHELSKRKKVEILNYAAI

SEQ ID NO: 12973 - protein, 557 aa, Homo sapiens [sequence omitted]

SEQ ID NO: 12974 - protein, 155 aa, Homo sapiens
MTCTHRRCGPPSLLGDCGVGGMRLKPFTRAVPACPLTCSPVHAAPPPPRFPERAAFGEGSPTHSPPHPPQRLQPLVHAVPKPARAAPTLHTAPCTAPHTFTAPVAQNPSLLALHALHWACSPHSAQLNAASPRAPQGLQPRLNFFCQAHTYLPMA

SEQ ID NO: 12975 - protein, 195 aa, Homo sapiens [sequence omitted]

SEQ ID NO: 12976 - protein, 86 aa, Homo sapiens
MGRKDAATIKLPVDQYRKQIGKQDYKKTKPILRATKLKAEAKKTAIGIKEVGLVLAAILALLLAFYAFFYLRLTTDVDPDLDQDED

SEQ ID NO: 12977 - protein, 54 aa, Homo sapiens
MGRKDAATIKLPVDQYRKQIGKQDYKKTKPILRATKLKAEAKKTAIGIKTHHGC

SEQ ID NO: 12978 - protein, 54 aa, Homo sapiens; identical to SEQ ID NO: 12977

SEQ ID NO: 12979 - protein, 54 aa, Homo sapiens; identical to SEQ ID NO: 12977

SEQ ID NO: 12980 - protein, 86 aa, Homo sapiens; identical to SEQ ID NO: 12976

SEQ ID NO: 12981 - protein, 86 aa, Homo sapiens; identical to SEQ ID NO: 12976

SEQ ID NO: 12982 - protein, 86 aa, Homo sapiens; identical to SEQ ID NO: 12976

SEQ ID NO: 12983 - protein, 86 aa, Homo sapiens; identical to SEQ ID NO: 12976

SEQ ID NO: 12984 - protein, 86 aa, Homo sapiens; identical to SEQ ID NO: 12976

SEQ ID NO: 12985 - protein, 120 aa, Homo sapiens
MTMTMSYKAIEKIPRCSWNREEPGEQWNKIYSVETGLLGTYSFEWQSQVANKTMRKRNTNSICGRQHEPHCPVSITRAIAQPQLLTFPDSLASRGGHMTQSGQCHVSGSLLGRGHKSRGR

SEQ ID NO: 12986 - protein, 155 aa, Homo sapiens; identical to SEQ ID NO: 12974

SEQ ID NO: 12987 - protein, 86 aa, Homo sapiens; identical to SEQ ID NO: 12976

SEQ ID NO: 12988 - protein, 54 aa, Homo sapiens; identical to SEQ ID NO: 12977

SEQ ID NO: 12989 - protein, 54 aa, Homo sapiens; identical to SEQ ID NO: 12977

SEQ ID NO: 12990 - protein, 54 aa, Homo sapiens; identical to SEQ ID NO: 12977

SEQ ID NO: 12991 - protein, 86 aa, Homo sapiens; identical to SEQ ID NO: 12976

SEQ ID NO: 12992 - protein, 86 aa, Homo sapiens; identical to SEQ ID NO: 12976

SEQ ID NO: 12993 - protein, 86 aa, Homo sapiens; identical to SEQ ID NO: 12976

SEQ ID NO: 12994 - protein, 86 aa, Homo sapiens; identical to SEQ ID NO: 12976

SEQ ID NO: 12995 - protein, 86 aa, Homo sapiens; identical to SEQ ID NO: 12976

SEQ ID NO: 12996 - protein, 195 aa, Homo sapiens [sequence omitted]

SEQ ID NO: 12997 - protein, 382 aa, Homo sapiens [sequence omitted]

SEQ ID NO: 12998 - protein, 155 aa, Homo sapiens; identical to SEQ ID NO: 12974

SEQ ID NO: 12999 - protein, 120 aa, Homo sapiens; identical to SEQ ID NO: 12985

SEQ ID NO: 13000 - protein, 142 aa, Homo sapiens
MIVSGKKLRLTIIECGCDINMMIDLAEVADLVLMLIDASFGFEMETFEFLNICQVHGFPKIMGVLTHLDFFKHNKQLKKTKKRLKHRFWTEVYLVAKLFCLSGMVHGEYQNQEMHNLGHFITVMKFRPLTWQTSHPYILADR

SEQ ID NO: 13001 - protein, 142 aa, Homo sapiens; identical to SEQ ID NO: 13000

SEQ ID NO: 13002 - protein, 142 aa, Homo sapiens; identical to SEQ ID NO: 13000

SEQ ID NO: 13003 - protein, 142 aa, Homo sapiens; identical to SEQ ID NO: 13000

SEQ ID NO: 13004 - protein, 2468 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 13005 - protein, 2342 aa, Homo sapiens
MITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 13006 - protein, 507 aa, Homo sapiens
MGRKKIQITRIMDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 13007 - protein, 487 aa, Homo sapiens
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 13008 - protein, 237 aa, Homo sapiens
MNPIAMARSRGPIQSSGPTIQDYLNRPRPTWEEVKEQLEKKKKGSKALAEFEEKMNENWKKELEKHREKLLSGSESSSKKRQRKKKEKKKSGRYSSSSSSSSDSSSSSSDSEDEDKKQGKRRKKKKNRSHKSSESSMSETESDSKDSLKKKKKSKDGTEKEKDIKGLSKKRKMYSEDKPLSSESLSESEYIEEVRAKKKKSSEEREKATEKTKKKKKHKKHSKKKKKKAASSSPDSP

SEQ ID NO: 13009 - protein, 328 aa, Homo sapiens
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSGSNPARPGGFPGANSPGPVADLYGPASQDSGVGNYISAASPQPGSGFGHGIAGPLIATAFTNGYH

SEQ ID NO: 13010 - protein, 251 aa, Homo sapiens
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 13011 - protein, 1314 aa, Homo sapiens
MKDNDKNMSTEDTKKNSDEKTDEEKITSFASANVSSDQWSLEDRHSLDSNTPLFPEDSSVGELSFKSENQEEFWHSNPSHLSLDLSGIDSCEMSDSGSQVPDSLPSTPSPVESTKSFSVHSDRESSITNDMGFSDDFSLLESQERCEEELLQLLTHILNYVMCKGLEKSDDDTWIERGQVFSALSKPGISSELLRPSDEIKLTLLQKMLEWAISENREAKTNPVTAENAFRLVLIIQDFLQSEGLVNSNMWTEKLLEDMMLLFDCLSVCYSESPVWVKLSQIQIQLLLGFIGRGNLQVCAMASAKLNTLLQTKVIENQDEACYILGKLEHVLSQSIKEQTEIYSFLIPLVRTLVSKIYELLFMNLHLPSLPFTNGSSSFFEDFQEYCNSNEWQVYIEKYIVPYMKQYEAHTFYDGHENMALYWKDCYEALMVNMHKRDREGGESKLKFQELFVEPFNRKARQENLRYNNMLKRLSSQQLATLRRWKAIQLYLTCERGPWAKRKQNPIHWKLANVENYSRMRLKLVPNYNFKTHEEASALRDNLGIQHSQPSSDTLLLEVVKQVKVSDMVEDKLDLPEEDITARVNVDEKEEQDQKEKLVLMEDCELITIIDVIPGRLEITTQHIYFYDGSIEKEDGVGFDFKWPHSQIREIHLRRYNLRRSALEIFHVDQSNYFLNFKKEVRNKIYSRLLSLHSPNSYYGSRSPQELFKASGLTQKWVNREISNFDYLIQINTMAGRTYNDLAQYPVFPWILQDYTSEELDLNNPAVFRDLSKPIGVVNEKNAKAMREKYENFEDPMGTIDKFHYGTHYSNSAGVMHYLIRVEPFTTLHIQLQSGRFDCADRQFHSIPATWQALMDNPYDVKELIPEFFYFPEFLENQNQFNLGRLQISKELVNDVILPKWAKSAEDFIYKHRKALESEYVSAHLHEWIDLIFGYKQRGPAAVEALNVFYYCSYEGAVDLDALTDEKERKALEGMINNFGQTPCQLLKITISMNYVIGTHGWLPYDRNISNYFTFIKDQTVTNPKTQRSINGSFAPGLEITSKLFVVSHDAKLLFSAGYWDNSIQVMSLTKGKIISHIIRHMDIVTCLATDYCGIHLISGSRDTTCMIWQITQQGGVPVGLASKPFQILYGHTNEVLSVGISTELDMAVSGSRDGTVIIHTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSK

SEQ ID NO: 13012 - protein, 192 aa, Homo sapiens
MGKGCKVVVCGLLSVGKTAILEQLLYGNHTIGMEDCETMEDVYMASVETDRGVKEQLHLYDTRGLQEGVELPKHYFSFADGFVLVYSVNNLESFQRVELLKKEIDKFKDKKEVAIVVLGNKIDLSEQRQVDAEVAQQWAKSEKVRLWEVTVTDRKTLIEPFTLLASKLSQPQSKSSFPLPGRKNKGNSNSEN

SEQ ID NO: 13013 - protein, 1427 aa, Homo sapiens
MLLPSDVARLVLGYLQQENLISTCQTFILESSDLKEYAEHCTDEGFIPACLLSLFGKNLTTILNEYVAMKTKETSNNVPAIMSSLWKKLDHTLSQIRSMQSSPRFAGSQRARTRTGIAEIKRQRKLASQTAPASAELLTLPYLSGQFTTPPSTGTQVTRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSLDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNAMKNSNNHDVLRQEDQENFSQISTSIQKKAFKTAVPTEQKCDIDITFESVPNLNDFNQRGNSNAECNPHCAELNTNQMSTETEMAIGIEKNSLSSNVPSESQLQPDQPDIPITSFVSLGCEANNENLILSGKSSQLLSQDTSLTGKPSKKSQFCENSNDTVKLKINFHGSKSSDSSEIHKSKIEINVLEPVMSQLSNCQDNSCLQSEILPVSVESSHLNVSGQIEIHLGDSLSSTKQPSNDSASVELNHTENEAQASKSENSQEPSSSVKEENTIFLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGSAIIIASPVQPVLQGMVGMIPVSVVGQNGNNFSTPPREVLHMPVTAPVCNRSIPQFPAPPKSQKAQGLRNKPCIGKQVNNLVDSSGHSVGCHAQKTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENELCSDVERQKNPENSKLSIGQRNGGLRSEKSIASLQEMTKKQGTSSNNKNVLSVGTAVKDLKQEQTKSASSLITTEMLQDIQRHSSVSRLADSSDLPVPRTPGSGAGEKHKEEPIDIIKAPSSRRFSEDSSTSKVMVPPVTPDLPACSPASETGSENSVNMAAHTLMILSRAAISRTTSATPLKDNTQQFRASSRSTTKKRKIEELDERERNSRPSSKNLTNSSIPMKKKKIKKKKLPSSFPAGMDVDKFLLSLHYDE

SEQ ID NO: 13014 - protein, 1304 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 13015 - protein, 1183 aa, Homo sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 13016 - protein, 856 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 13017 - protein, 750 aa, Homo sapiens
MEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 13018 - protein, 679 aa, Homo sapiens
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVLFFLPSDVTQNSEQPAPEEYDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDRQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 13019 - protein, 847 aa, Homo sapiens
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 13020 - protein, 889 aa, Homo sapiens
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 13021 - protein, 678 aa, Homo sapiens
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 13022 - protein, 129 aa, Homo sapiens
MAAVLGALGATRRLLAALRGQSLGLAAMSSGTHRLTAEERNQAILDLKAAGWSELSERDAIYKEFSFHNFNQAFGFMSRVALQAEKMNHHPEWFNVYNVQITLTSHDCGELTKKDVKLAKFIEKAAASV

SEQ ID NO: 13023 - protein, 583 aa, Homo sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 13024 - protein, 209 aa, Homo sapiens
MEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCHKH

SEQ ID NO: 13025 - protein, 1205 aa, Homo sapiens
MDSEIGCLIRFYAGKPHSTGSSERIQLSGMYNVRKGKMQLPVNRWTRRQVILCGTCLIVSSVKDSLTGKMHVLPLIGGKVEEVKKHQHCLAFSSSGPQSQTYYICFDTFTEYLRWLRQVSKVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 13026 - protein, 931 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 13027 - protein, 931 aa, Homo sapiens; identical to SEQ ID NO: 13026

SEQ ID NO: 13028 - protein, 243 aa, Homo sapiens
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 13029 - protein, 117 aa, Homo sapiens
MAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEGTLD

SEQ ID NO: 13030 - protein, 337 aa, Homo sapiens
MATASPAADGGRGRPWEGGLVSWPPAPPLTLPWTWMGPSWGQHPGHWGFPALTEPSASPAAGLGIFEVRRVLDASGCSMLAPLQTGAARFSSYLLSRARKVLGSHLFSPCGVPEFCSISTRKLAAHGFGASMAAMVSFPPQRYHYFLVLDFEATCDKPQIHPQEIIEFPILKLNGRTMEIESTFHMYVQPVVHPQLTPFCTELTGIIQAMVDGQPSLQQVLERVDEWMAKEGLLDPNVKSIFVTCGDWDLKVMLPGQCQYLGLPVADYFKQWINLKKAYSFAMGCWPKNGLLDMNKGLSLQHIGRPHSGIDDCKNIANIMKTLAYRGFIFKQTSKPF

SEQ ID NO: 13031 - protein, 160 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 13032 - protein, 926 aa, Homo sapiens
MTSRFRLPAGRTYNVRASELARDRQHTEVVCNILLLDNTVQAFKVNKHDQGQVLLDVVFKHLDLTEQDYFGLQLADDSTDNPRWLDPNKPIRKQLKRGSPYSLNFRVKFFVSDPNKLQEEYTRYQYFLQIKQDILTGRLPCPSNTAALLASFAVQSELGDYDQSENLSGYLSDYSFIPNQPQDFEKEIAKLHQQHIGLSPAEAEFNYLNTARTLELYGVEFHYARDQSNNEIMIGVMSGGILIYKNRVRMNTFPWLKIVKISFKCKQFFIQLRKELHESRETLLGFNMVNYRACKNLWKACVEHHTFFRLDRPLPPQKNFFAHYFTLGSKFRYCGRTEVQSVQYGKEKANKDRVFARSPSKPLARKLMDWEVVSRNSISDDRLETQSLPSRSPPGTPNHRNSTFTQEGTRLRPSSVGHLVDHMVHTSPSEVFVNQRSPSSTQANSIVLESSPSQETPGDGKPPALPPKQSKKNSWNQIHYSHSQQDLESHINETFDIPSSPEKPTPNGGIPHDNLVLIRMKPDENGRFGFNVKGGYDQKMPVIVSRVAPGTPADLCVPRLNEGDQVVLINGRDIAEHTHDQVVLFIKASCERHSGELMLLVRPNAVYDVVEEKLENEPDFQYIPEKAPLDSVHQDDHSLRESMIQLAEGLITGTVLTQFDQLYRKKPGMTMSCAKLPQNISKNRYRDISPYDATRVILKGNEDYINANYINMEIPSSSIINQYIACQGPLPHTCTDFWQMTWEQGSSMVVMLTTQVERGRVKCHQYWPEPTGSSSYGCYQVTCHSEEGNTAYIFRKMTLFNQEKNESRPLTQIQYIAWPDHGVPDDSSDFLDFVCHVRNKRAGKEEPVVVHCSAGIGRTGVLITMETAMCLIECNQPVYPLDIVRTMRDQRAMMIQTPSQYRFVCEAILKVYEEGFVKPLTTSTNK

SEQ ID NO: 13033 - protein, 185 aa, Homo sapiens
MVKLAAKCILADPAVGKTALAQIFRSDGAHFQKSYTLTTGMDLVVKTVPVPDTGDSVELFIFDSAGKELFSEMLDKLWESPNVLCLVYDVTNEESFNNCSKWLEKARSQAPGISLPGVLVGNKTDLAGRRAVDSAEARAWALGQGLECFETSVKEMENFEAPFHCLAKQFHQLYREKVEVFRALA

SEQ ID NO: 13034 - protein, 980 aa, Homo sapiens
MKSLKAKFRKSDTNEWNKNDDRLLQAVENGDAEKVASLLGKKGASATKHDSEGKTAFHLAAAKGHVECLRVMITHGVDVTAQDTTGHSALHLAAKNSHHECIRRLLQSKCPAESVDSSGKTALHYAAAQGCLQAVQILCEHKSPINLKDLDGNIPLLLAVQNGHSEICHFLLDHGADVNSRNKSGRTALMLACEIGSSNAVEALIKKGADLNLVDSLGYNALHYSKLSENAGIQSLLLSKISQDADLKTPTKPKQHDQVSKISSERSGTPKTRKAPPPPISPTQLSDVSSPRSITSTPLSGKESVFFAEPPFKAEISSIRENKDRLSDSTTGADSLLDISSEADQQDLLSLLQAKVASLTLHNKELQDKLQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 13035 - protein, 151 aa, Homo sapiens
MAEDLSAATSYTEDDFYCPVCQEVLKTPVRTTACQHVNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 13036 - protein, 152 aa, Homo sapiens
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLNDNGLQKSSSLKCIDLTPVSSMASSIKKTGKSTSSYF

SEQ ID NO: 13037 - protein, 173 aa, Homo sapiens
MCTNIVYEWLKALQLPQYAESFVDNGYDDLEVCKQIGDPDLDAIGVLAPAHRRRILEAVRRLREQDANAAGLYFTLEPQPAPPGPPADAVPTGRRGEPCGGPAQGTRGDSRGHTTAPRSRELVSYPKLKLKIMIRDKLVRDGIHLSKPPYSRKVPMAGILEYLMNWPKSSQSR

SEQ ID NO: 13038 - protein, 156 aa, Homo sapiens [sequence omitted]

SEQ ID NO: 13039 - protein, 607 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 13040 - protein, 585 aa, Homo sapiens
MKKQANKTASSGSSDKDSSAESSAPEEGEVSDSDSNSSSSSSDSDSSSEDEEFHDGYGEDLMGDEEDRARLEQMTEKEREQELFNRIEKREVLKRRFEIKKKLKTAKKKEKKEKKKKQEEEQEKKKLTQIQESQVTSHNKERRSKRDEKLDKKSQAMEELKAEREKRKNRTAELLAKKQPLKTSEVYSDDEEEEEDDKSSEKSDRSSRTSSSDEEEEKEEIPPKSQPVSLPEELNRVRLSRHKLERWCHMPFFAKTVTGCFVRIGIGNHNSKPVYRVAEITGVVETAKVYQLGGTRTNKGLQLRHGNDQRVFRLEFVSNQEFTESEFMKWKEAMFSAGMQLPTLDEINKKELSIKEALNYKFNDQDIEEIVKEKERFRKAPPNYAMKKTQLLKEKAMAEDLGDQDKAKQIQDQLNELEERAEALDRQRTKNISAISYINQRNREWNIVESEKALVAESHNMKNQQMDPFTRRQCKPTIVSNSRDPAVQAAILAQLNAKYGSGVLPDAPKEMSKGQGKDKDLNSKSASDLSEDLFKVHDFDVKIDLQVPSSESKALAITSKAPPAKDGAPRRSLNLEDYKKRRGLI

SEQ ID NO: 13041 - protein, 201 aa, Homo sapiens
MAVEALHCGLNPRGIDHPAHAEGIKLQIEGEGVESQSIKNKNFQKVPDQKGTPKRLQAEAETAKSATVKLSKPVALWTQQDVCKWLKKHCPNQYQIYSESFKQHDITGRALLRLTDKKLERMGIAQENLRQHILQQVLQLKVREEVRNLQLLTQGTLLLPDGWMDGEIRRKATLLLGQTGVRENLLLFLHRISIIENSIQI

SEQ ID NO: 13042 - protein, 696 aa, Homo sapiens
MEASVILPILKKKLAFLSGGKDRRSGLILTIPLCLEQTNMDELSVTLDYLLSIPSEKCKARGFTVIVDGRKSQWNVVKTVVVMLQNVVPAEVSLVCVVKPDEFWDKKVTHFCFWKEKDRLGFEVILVSANKLTRYIEPCQLTEDFGGSLTYDHMDWLNKRLVFEKFTKESTSLLDELALINNGSDKGNQQEKERSVDLNFLPSVDPETVLQTGHELLSELQQRRFNGSDGGVSWSPMDDELLAQPQVMKLLDSLREQYTRYQEVCRQRSKRTQLEEIQQKVMQVVNWLEGPGSEQLRAQWGIGDSIRASQALQQKHEEIESQHSEWFAVYVELNQQIAALLNAGDEEDLVELKSLQQQLSDVCYRQASQLEFRQNLLQAALEFHGVAQDLSQQLDGLLGMLCVDVAPADGASIQQTLKLLEEKLKSVDVGLQGLREKGQGLLDQISNQASWAYGKDVTIENKENVDHIQGVMEDMQLRKQRCEDMVDVRRLKMLQMVQLFKCEEDAAHAVEWLSELLDALLKTHIRLGDDAQETKVLLEKHRKFVDVAQSTYDYGRQLLQATVVLCQSLRCTSRSSGDTLPRLNRVWKQFTIASEERVHRLEMAIAFHSNAEKILQDCPEEPEAINDEEQFDEIEAVGKSLLDRLTVPVVYPDGTEQYFGSPSDMASTAENIRDRMKLVNLKRQQLRHPEMVTTES

SEQ ID NO: 13043 - protein, 318 aa, Homo sapiens
MAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 13044 - protein, 582 aa, Homo sapiens
MESVKQRILAPGKEGLKNFAGKSLGQIYRVLEKKQDTGETIELTEDGKPLEVPERKAPLCDCTCFGLPRRYIIAIMSGLGFCISFGIRCNLGVAIVDMVNNSTIHRGGKVIKEKAKFNWDPETVGMIHGSFFWGYIITQIPGGYIASRLAANRVFGAAILLTSTLNMLIPSAARVHYGCVIFVRILQGLVEGVTYPACHGIWSKWAPPLERSRLATTSFCGSYAGAVIAMPLAGILVQYTGWSSVFYVYGSFGMVWYMFWLLVSYESPAKHPTITDEERRYIEESIGESANLLGAMEKFKTPWRKFFTSMPVYAIIVANFCRSWTFYLLLISQPAYFEEVFGFEISKVGMLSAVPHLVMTIIVPIGGQIADFLRSKQILSTTTVRKIMNCGGFGMEATLLLVVGYSHTRGVAISFLVLAVGFSGFAISGFNVNHLDIAPRYASILMGISNGVGTLSGMVCPIIVGAMTKNKSREEWQYVFLIAALVHYGGVIFYAIFASGEKQPWADPEETSEEKCGFIHEDELDEETGDITQNYINYGTTKSYGATTQANGGWPSGWEKKEEFVQGEVQDSHSYKDRVDYS

SEQ ID NO: 13045 - protein, 223 aa, Homo sapiens
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAELIHNTRFLL

SEQ ID NO: 13046 - protein, 485 aa, Homo sapiens
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAGDSFNTQNEPEDMMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 13047 - protein, 730 aa, Homo sapiens
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 13048 - protein, 126 aa, Homo sapiens
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGRGNIFQKRR

SEQ ID NO: 13049 - protein, 206 aa, Homo sapiens
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 13050 - protein, 282 aa, Homo sapiens
MSCGRPPPDVDGMITLKVDNLTYRTSPDSLRRVFEKYGRVGDVYIPREPHTKAPRGFAFVRFHDRRDAQDAEAAMDGAELDGRELRVQVARYGRRDLPRSRQGEPRGRSRGGGYGRRSRSYGRRSRSPRRRHRSRSRGPSCSRSRSRSRYRGSRYSRSPYSRSPYSRSRYSRSPYSRSRYRESRYGGSHYSSSGYSNSRYSRYHSSRSHSKSGSSTSSRSASTSKSSSARRSKSSSVSRSRSRSRSSSMTRSPPRVSKRKSKSRSRSKRPPKSPEEEGQMSS

SEQ ID NO: 13051 - protein, 369 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 13052 - protein, 897 aa, Homo sapiens
MEQLADVTLRRLLDNEVFDLDPDLQEPSQITKRDLEARAQNEFFRAFFRLPRKEKLHAVVDCSLWTPFSRCHTAGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQALPEAAERDWTVSLEHILASLLTEQSLVNFFEKPLDMKSKLENAKINQYNLKTFEMSHQSQSELKLSNL

SEQ ID NO: 13053 - protein, 1419 aa, Homo sapiens
MDGGGVCVGRGDLLSSPQALGQLLRKESRPRRAMKPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 13054 - protein, 1409 aa, Homo sapiens
MKSSGPVERLLRALGRRDSSRAASRPRKAEPHSFREKVFRKKPPVCAVCKVTIDGTGVSCRVCKVATHRKCEAKVTSACQALPPVELRRNTAPVRRIEHLGSTKSLNHSKQRSTLPRSFSLDPLMERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 13055 - protein, 1285 aa, Homo sapiens
MERRWDLDLTYVTERILAAAFPARPDEQRHRGHLRELAHVLQSKHRDKYLLFNLSEKRHDLTRLNPKVQDFGWPELHAPPLDKLCSICKAMETWLSADPQHVVVLYCKGNKGKLGVIVSAYMHYSKISAGADQALATLTMRKFCEDKVATELQPSQRRYISYFSGLLSGSIRMNSSPLFLHYVLIPMLPAFEPGTGFQPFLKIYQSMQLVYTSGVYHIAGPGPQQLCISLEPALLLKGDVMVTCYHKGGRGTDRTLVFRVQFHTCTIHGPQLTFPKDQLDEAWTDERFPFQASVEFVFSSSPEKIKGSTPRNDPSVSVDYNTTEPAVRWDSYENFNQHHEDSVDGSLTHTRGPLDGSPYAQVQRPPRQTPPAPSPEPPPPPMLSVSSDSGHSSTLTTEPAAESPGRPPPTAAERQELDRLLGGCGVASGGRGAGRETAILDDEEQPTVGGGPHLGVYPGHRPGLSRHCSCRQGYREPCGVPNGGYYRPEGTLERRRLAYGGYEGSPQGYAEASMEKRRLCRSLSEGLYPYPPEMGKPATGDFGYRAPGYREVVILEDPGLPALYPCPACEEKLALPTAALYGLRLEREAGEGWASEAGKPLLHPVRPGHPLPLLLPACGHHHAPMPDYSCLKPPKAGEEGHEGCSYTMCPEGRYGHPGYPALVTYSYGGAVPSYCPAYGRVPHSCGSPGEGRGYPSPGAHSPRAGSISPGSPPYPQSRKLSYEIPTEEGGDRYPLPGHLASAGPLASAESLEPVSWREGPSGHSTLPRSPRDAPCSASSELSGPSTPLHTSSPVQGKESTRRQDTRSPTSAPTQRLSPGEALPPVSQAGTGKAPELPSGSGPEPLAPSPVSPTFPPSSPSDWPQERSPGGHSDGASPRSPVPTTLPGLRHAPWQGPRGPPDSPDGSPLTPVPSQMPWLVASPEPPQSSPTPAFPLAASYDTNGLSQPPLPEKRHLPGPGQQPGPWGPEQASSPARGISHHVTFAPLLSDNVPQTPEPPTQESQSNVKFVQDTSKFWYKPHLSRDQAIALLKDKDPGAFLIRDSHSFQGAYGLALKVATPPPSAQPWKGDPVEQLVRHFLIETGPKGVKIKGCPSEPYFGSLSALVSQHSISPISLPCCLRIPSKDPLEETPEAPVPTNMSTAADLLRQGAACSVLYLTSVETESLTGPQAVARASSAALSCSPRPTPAVVHFKVSAQGITLTDNQRKLFFRRHYPVNSITFSSTDPQDRRWTNPDGTTSKIFGFVAKKPGSPWENVCHLFAELDPDQPAGAIVTFITKVLLGQRK

SEQ ID NO: 13056 - protein, 773 aa, Homo sapiens
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 13057 - protein, 240 aa, Homo sapiens
MSPLLFGAGLVVLNLVTSARSQKTEPLSGSGDQPLFRGADRYDFAIMIPPGGTECFWQFAHQTGYFYFSCEVQRTVGMSHDRHVAATAHNPQGFLIDTSQGVRGQINFSTQETGFYQLCLSNQHNHFGSVQVYLNFGVFYEGPETDHKQKERKQLNDTLDAIEDGTQKVQNNIFHMWRYYNFARMRKMADFFLIQSNYNYVNWWSTAQSLVIILSGILQLYFLKRLFNVPTTTDTKKPRC

SEQ ID NO: 13058 - protein, 112 aa, Homo sapiens
MQDTGSVVPLHWFGFGYAALVASGGIIGYVKAGSVPSLAAGLLFGSLAGLGAYQLSQDPRNVWVFLATSGTLAGIMGMRFYHSGKFMPAGLIAGASLLMVAKVGVSMFNRPH

SEQ ID NO: 13059 - protein, 110 aa, Homo sapiens
MAAVVAKREGPPFISEAAVRGNAAVLDYCRTSVSALSGATAGILGLTGLYGFIFYLLASVLLSLLLILKAGRRWNKYFKSRRPLFTGGLIGGLFTYVLFWTFLYGMVHVY

SEQ ID NO: 13060 - protein, 110 aa, Homo sapiens; identical to SEQ ID NO: 13059

SEQ ID NO: 13061 - protein, 264 aa, Homo sapiens
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 13062 - protein, 224 aa, Homo sapiens
MDCREMDLYEDYQSPFDFDAGVNKSYLYLSPSGNSSPPGSPTLQKFGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 13063 - protein, 207 aa, Homo sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKLQAFSHSFSIRSIQHSISMPAMRNSPTFKSFEEKVENLKSKVGGTKPAGGDFGEVLNSAANASATTTEPLPEKTQESL

SEQ ID NO: 13064 - protein, 184 aa, Homo sapiens
MDRGEQGLLRTDPVPEEGEDVAATISATETLSEEEQEELRRELAKVEEEIQTLSQVLAAKEKHLAEIKRKLGINSLQELKQNIAKGWQDVTATSAYKKTSETLSQAGQKASAAFSSVGSVITKKLEDVKNSPTFKSFEEKVENLKSKVGGTKPAGGDFGEVLNSAANASATTTEPLPEKTQESL

SEQ ID NO: 13065 - protein, 538 aa, Homo sapiens
MEESVNQMQPLNEKQIANSQDGYVWQVTDMNRLHRFLCFGSEGGTYYIKEQKLGLENAEALIRLIEDGRGCEVIQEIKSFSQEGRTTKQEPMLFALAICSQCSDISTKQAAFKAVSEVCRIPTHLFTFIQFKKDLKESMKCGMWGRALRKAIADWYNEKGGMALALAVTKYKQRNGWSHKDLLRLSHLKPSSEGLAIVTKYITKGWKEVHELYKEKALSVETEKLLKYLEAVEKVKRTRDELEVIHLIEEHRLVREHLLTNHLKSKEVWKALLQEMPLTALLRNLGKMTANSVLEPGNSEVSLVCEKLCNEKLLKKARIHPFHILIALETYKTGHGLRGKLKWRPDEEILKALDAAFYKTFKTVEPTGKRFLLAVDVSASMNQRVLGSILNASTVAAAMCMVVTRTEKDSYVVAFSDEMVPCPVTTDMTLQQVLMAMSQIPAGGTDCSLPMIWAQKTNTPADVFIVFTDNETFAGGVHPAIALREYRKKMDIPAKLIVCGMTSNGFTIADPDDRGMLDMCGFDTGALDVIRNFTLDMI

SEQ ID NO: 13066 - protein, 395 aa, Homo sapiens
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMDLVKSHLMFAVREEVEVLKEQIRELAERNAALEQENGLLRALASPEQLAQLPSSGVPRLGPPAPNGPSV

SEQ ID NO: 13067 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 13068 - protein, 1119 aa, Homo sapiens
MMTSVSSDHCRGAREKPQISAAQSTQPQKQVVQATAEQMRLAQVIFDKNDSDFEAKVKQLMEVTGKNQDECIVALHDCNGDVNKAINILLEGNSDTTSWETVGCKKKNFAKENSENKENREKKSEKESSRGRGNNNRKGRGGNRGREFRGEENGIDCNQVDKPSDRGKRARGRGFGRGRGRGAGRFSTQGMGTFNPADYSDSTSTDVCGTKLVVWEAAQNGADEGTELASNTHNIAQDLSNKSSYGLKGAWKNSVEEWTTEDWTEDLSETKVFTASSAPAENHILPGQSIDLVALLQKPVPHSQASEANSFETSQQQGFGQALVFTNSQHNNQMAPGTGSSTAVNSCSPQSLSSVLGSGFGELAPPKMANITSSQILDQLKAPSLGQFTTTPSTQQNSTSHPTTTTSWDLKPPTSQSSVLSHLDFKSQPEPSPVLSQLSQRQQHQSQAVTVPPPGLESFPSQAKLRESTPGDSPSTVNKLLQLPSTTIENISVSVHQPQPKHIKLAKRRIPPASKIPASAVEMPGSADVTGLNVQFGALEFGSEPSLSEFGSAPSSENSNQIPISLYSKSLSEPLNTSLSMTSAVQNSTYTTSVITSCSLTSSSLNSASPVAMSSSYDQSSVHNRIPYQSPVSSSESAPGTIMNGHGGGRSQQTLDTPKTTGPPSALPSVSSLPSTTSCTALLPSTSQHTGDLTSSPLSQLSSSLSSHQSSLSAHAALSSSTSHTHASVESASSHQSSATFSTAATSVSSSASSGASLSSSMNTANSLCLGGTPASASSSSSRAAPLVTSGKAPPNLPQGVPPLLHNQYLVGPGGLLPAYPIYGYDELQMLQSRLPVDYYGIPFAAPTALASRDGSLANNPYPGDVTKFGRGDSASPAPATTPAQPQQSQSQTHHTAQQPFVNPALPPGYSYTGLPYYTGMPSAFQYGPTMFVPPASAKQHGVNLSTPTPPFQQASGYGQHGYSTGYDDLTQGTAAGDYSKGGYAGSSQAPNKSAGSGPGKGVSVSSSTTGLPDMTGSVYNKTQTFDKQGFHAGTPPPFSLPSVLGSTGPLASGAAPGYAPPPFLHILPAHQQPHSQLLHHHLPQDAQSGSGQRSQPSSLQPKSQASKPAYGNSPYWTN

SEQ ID NO: 13069 - protein, 1087 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAHQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQTGSGQRSQTSSIPQKPQTNKSAYNSYSWGAN

SEQ ID NO: 13070 - protein, 1292 aa, Homo sapiens
MADPAAPTPAAPAPAQAPAPAPEAVPAPAAAPVPAPAPASDSASGPSSDFGPEAGSQRLLFSHDLVSGRYRGSVHFGLVRLIHGEDSDSEGEEEGRGSSGCSEAGGAGHEEGRASPLRRGYVRVQWYPEGVKQHVKETKLKLEDRSVVPRDVVRHMRSTDSQCGTVIDVNIDCAVKLIGTNCIIYPVNSKDLQHIWPFMYGDYIAYDCWLGKVYDLKNQIILKLSNGARCSMNTEDGAKLYDVCPHVSDSGLFFDDSYGFYPGQVLIGPAKIFSSVQWLSGVKPVLSTKSKFRVVVEEVQVVELKVTWITKSFCPGGTDSVSPPPSVITQENLGRVKRLGCFDHAQRQLGERCLYVFPAKVEPAKIAWECPEKNCAQGEGSMAKKVKRLLKKQVVRIMSCSPDTQCSRDHSMEDPDKKGESKTKSEAESASPEETPDGSASPVEMQDEGAEEPHEAGEQLPPFLLKEGRDDRLHSAEQDADDEAADDTDDTSSVTSSASSTTSSQSGSGTSRKKSIPLSIKNLKRKHKRKKNKITRDFKPGDRVAVEVVTTMTSADVMWQDGSVECNIRSNDLFPVHHLDNNEFCPGDFVVDKRVQSCPDPAVYGVVQSGDHIGRTCMVKWFKLRPSGDDVELIGEEEDVSVYDIADHPDFRFRTTDIVIRIGNTEDGAPHKEDEPSVGQVARVDVSSKVEVVWADNSKTIILPQHLYNIESEIEESDYDSVEGSTSGASSDEWEDDSDSWETDNGLVEDEHPKIEEPPIPPLEQPVAPEDKGVVISEEAATAAVQGAVAMAAPMAGLMEKAGKDGPPKSFRELKEAIKILESLKNMTVEQLLTGSPTSPTVEPEKPTREKKFLDDIKKLQENLKKTLDNVAIVEEEKMEAVPDVERKEDKPEGQSPVKAEWPSETPVLCQQCGGKPGVTFTSAKGEVFSVLEFAPSNHSFKKIEFQPPEAKKFFSTVRKEMALLATSLPEGIMVKTFEDRMDLFSALIKGPTRTPYEDGLYLFDIQLPNIYPAVPPHFCYLSQCSGRLNPNLYDNGKVCVSLLGTWIGKGTERWTSKSSLLQVLISIQGLILVNEPYYNEAGFDSDRGLQEGYENSRCYNEMALIRVVQSMTQLVRRPPEVFEQEIRQHFSTGGWRLVNRIESWLETHALLEKAQALPNGVPKASSSPEPPAVAELSDSGQQEPEDGGPAPGEASQGSDSEGGAQSLASASRDHTDQTSETAPDASVPPSVKPKKRRKSYRSFLPEKSGYPDIGFPLFPLSKGFIKSIRGVLTQFRAALLEAGMPECTEDK

SEQ ID NO: 13071 - protein, 494 aa, Homo sapiens
MFEIKKICCIGAGYVGGPTCSVIAHMCPEIRVTVVDVNESRINAWNSPTLPIYEPGLKEVVESCRGKNLFFSTNIDDAIKEADLVFISVNTPTKTYGMGKGRAADLKYIEACARRIVQNSNGYKIVTEKSTVPVRAAESIRRIFDANTKPNLNLQVLSNPEFLAEGTAIKDLKNPDRVLIGGDETPEGQRAVQALCAVYEHWVPREKILTTNTWSSELSKLAANAFLAQRISSINSISALCEATGADVEEVATAIGMDQRIGNKFLKASVGFGGSCFQKDVLNLVYLCEALNLPEVARYWQQVIDMNDYQRRRFASRIIDSLFNTVTDKKIAILGFAFKKDTGDTRESSSIYISKYLMDEGAHLHIYDPKVPREQIVVDLSHPGVSEDDQVSRLVTISKDPYEACDGAHAVVICTEWDMFKELDYERIHKKMLKPAFIFDGRRVLDGLHNELQTIGFQIETIGKKVSSKRIPYAPSGEIPKFSLQDPPNKKPKV

SEQ ID NO: 13072 - protein, 176 aa, Homo sapiens
MCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 13073 - protein, 952 aa, Homo sapiens
MAEGGAADLDTQRSDIATLLKTSLRKGDTWYLVDSRWFKQWKKYVGFDSWDKYQMGDQNVYPGPIDNSGLLKDGDAQSLKEHLIDELDYILLPTEGWNKLVSWYTLMEGQEPIARKVVEQGMFVKHCKVEVYLTELKLCENGNMNNVVTRRFSKADTIDTIEKEIRKIFSIPDEKETRLWNKYMSNTFEPLNKPDSTIQDAGLYQGQVLVIEQKNEDGTWPRGPSTPNVKNSNYCLPSYTAYKNYDYSEPGRNNEQPGLCGLSNLGNTCFMNSAIQCLSNTPPLTEYFLNDKYQEELNFDNPLGMRGEIAKSYAELIKQMWSGKFSYVTPRAFKTQVGRFAPQFSGYQQQDCQELLAFLLDGLHEDLNRIRKKPYIQLKDADGRPDKVVAEEAWENHLKRNDSIIVDIFHGLFKSTLVCPECAKISVTFDPFCYLTLPLPMKKERTLEVYLVRMDPLTKPMQYKVVVPKIGNILDLCTALSALSGIPADKMIVTDIYNHRFHRIFAMDENLSSIMERDDIYVFEININRTEDTEHVIIPVCLREKFRHSSYTHHTGSSLFGQPFLMAVPRNNTEDKLYNLLLLRMCRYVKISTETEETEGSLHCCKDQNINGNGPNGIHEEGSPSEMETDEPDDESSQDQELPSENENSQSEDSVGGDNDSENGLCTEDTCKGQLTGHKKRLFTFQFNNLGNTDINYIKDDTRHIRFDDRQLRLDERSFLALDWDPDLKKRYFDENAAEDFEKHESVEYKPPKKPFVKLKDCIELFTTKEKLGAEDPWYCPNCKEHQQATKKLDLWSLPPVLVVHLKRFSYSRYMRDKLDTLVDFPINDLDMSEFLINPNAGPCRYNLIAVSNHYGGMGGGHYTAFAKNKDDGKWYYFDDSSVSTASEDQIVSKAAYVLFYQRQDTFSGTGFFPLDRETKGASAATGIPLESDEDSNDNDNDIENENCMHTN

SEQ ID NO: 13074 - protein, 485 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAGL

SEQ ID NO: 13075 - protein, 1035 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 13076 - protein, 1264 aa, Homo sapiens
MSTLYVSPHPDAFPSLRALIAARYGEAGEGPGWGGAHPRICLQPPPTSRTPFPPPRLPALEQGPGGLWVWGATAVAQLLWPAGLGGPGGSRAAVLVQQWVSYADTELIPAACGATLPALGLRSSAQDPQAVLGALGRALSPLEEWLRLHTYLAGEAPTLADLAAVTALLLPFRYVLDPPARRIWNNVTRWFVTCVRQPEFRAVLGEVVLYSGARPLSHQPGPEAPALPKTAAQLKKEAKKREKLEKFQQKQKIQQQQPPPGEKKPKPEKREKRDPGVITYDLPTPPGEKKDVSGPMPDSYSPRYVEAAWYPWWEQQGFFKPEYGRPNVSAANPRGVFMMCIPPPNVTGSLHLGHALTNAIQDSLTRWHRMRGETTLWNPGCDHAGIATQVVVEKKLWREQGLSRHQLGREAFLQEVWKWKEEKGDRIYHQLKKLGSSLDWDRACFTMDPKLSAAVTEAFVRLHEEGIIYRSTRLVNWSCTLNSAISDIEVDKKELTGRTLLSVPGYKEKVEFGVLVSFAYKVQGSDSDEEVVVATTRIETMLGDVAVAVHPKDTRYQHLKGKNVIHPFLSRSLPIVFDEFVDMDFGTGAVKITPAHDQNDYEVGQRHGLEAISIMDSRGALINVPPPFLGLPRFEARKAVLVALKERGLFRGIEDNPMVVPLCNRSKDVVEPLLRPQWYVRCGEMAQAASAAVTRGDLRILPEAHQRTWHAWMDNIREWCISRQLWWGHRIPAYFVTVSDPAVPPGEDPDGRYWVSGRNEAEAREKAAKEFGVSPDKISLQQDEDVLDTWFSSGLFPLSILGWPNQSEDLSVFYPGTLLETGHDILFFWVARMVMLGLKLTGRLPFREVYLHAIVRDAHGRKMSKSLGNVIDPLDVIYGISLQGLHNQLLNSNLDPSEVEKAKEGQKADFPAGIPECGTDALRFGLCAYMSQGRDINLDVNRILGYRHFCNKLWNATKFALRGLGKGFVPSPTSQPGGHESLVDRWIRSRLTEAVRLSNQGFQAYDFPAVTTAQYSFWLYELCDVYLECLKPVLNGVDQVAAECARQTLYTCLDVGLRLLSPFMPFVTEELFQRLPRRMPQAPPSLCVTPYPEPSECSWKDPEAEAALELALSITRAVRSLRADYNLTRIRPDCFLEVADEATGALASAVSGYVQALASAGVVAVLALGAPAPQGCAVALASDRCSIHLQLQGLVDPARELGKLQAKRVEAQRQAQRLRERRAASGYPVKVPLEVQEADEAKLQQTEAELRKVDEAIALFQKML

SEQ ID NO: 13077 - protein, 852 aa, Homo sapiens
MGLKDHLGHDLGHLYVESTDPQLSPAVPWSTVENPSMDTVNVGKDEKEASEENASSGDSEENTNSDHESEQLGSISVEPGLITKTHRQLCRSPCLEPHILKRNEILQDFKPEESQTTSKEAKKPPDVVREYQTKLEFALKLGYSEEQVQLVLNKLGTDALINDILGELVKLGNKSEADQTVSTINTITRETSSLESQRSESPMQEIVTDDGENLRPIVIDGSNVAMSHGNKEVFSCRGIKLAVDWFLERGHKDITVFVPAWRKEQSRPDALITDQEILRKLEKEKILVFTPSRRVQGRRVVCYDDRFIVKLAFESDGIIVSNDNYRDLANEKPEWKKFIDERLLMYSFVNDKFMPPDDPLGRHGPSLDNFLRKKPIVPEHKKQPCPYGKKCTYGHKCKYYHPERGSQPQRSVADELRAMSRNTAAKTANEGGLVKSNSVPCSTKADSTSDVKRGAPKRQSDPSIRTQVYQDLEEKLPTKNKLETRSVPSLVSIPATSTAKPQSTTSLSNGLPSGVHFPPQDQRPQGQYPSMMMATKNHGTPMPYEQYPKCDSPVDIGYYSMLNAYSNLSLSGPRSPERRFSLDTDYRISSVASDCSSEGSMSCGSSDSYVGYNDRSYVSSPDPQLEENLKCQHMHPHSRLNPQPFLQNFHDPLTRGQSYSHEEPKFHHKPPLPHLALHLPHSAVGARSSCPGDYPSPPSSAHSKAPHLGRSLVATRIDSISDSRLYDSSPSRQRKPYSRQEGLGSWERPGYGIDAYGYRQTYSLPDNSTQPCYEQFTFQSLPEQQEPAWRIPYCGMPQDPPRYQDNREKIYINLCNIFPPDLVRIVMKRNPHMTDAQQLAAAILVEKSQLGY

SEQ ID NO: 13078 - protein, 852 aa, Homo sapiens; identical to SEQ ID NO: 13077

SEQ ID NO: 13079 - protein, 354 aa, Homo sapiens
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSGSNQPFPIKPLSESKNRLLDSESQWLENGAEEGIVKSGV

SEQ ID NO: 13080 - protein, 723 aa, Homo sapiens
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTECPVRAVC

SEQ ID NO: 13081 - protein, 629 aa, Homo sapiens
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRAFMWFSDITKHKQTHTGEKPYKCDECGKNFTQSSNLIVHKRIHTGEKPYKCEKCGKAFTQFSHLTVHESIHT

SEQ ID NO: 13082 - protein, 579 aa, Homo sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTVSVENGDRGSKTFNLGTDPVSLRNYPYKICDSCEMNLKNISGLIISKKNCSRKKPDEFNVCEKLLLDIRHEKIPIGEKSYKYDQKRNAINYHQDLSQPSFGQSFEYSKNGQGFHDEAAFFTNKRSQIGETVCKYNECGRTFIESLKLNISQRPHLEMEPYGCSICGKSFCMNLRFGHQRALTKDNPYEYNEYGEIFCDNSAFIIHQGAYTRKILREYKVSDKTWEKSALLKHQIVHMGGKSYDYNENGSNFSKKSHLTQLRRAHTGEKTFECGECGKTFWEKSNLTQHQRTHTGEKPYECTECGKAFCQKPHLTNHQRTHTGEKPYECKQCGKTFCVKSNLTEHQRTHTGEKPYECNACGKSFCHRSALTVHQRTHTGEKPFICNECGKSFCVKSNLIVHQRTHTGEKPYKCNECGKTFCEKSALTKHQRTHTGEKPYECNACGKTFSQRSVLTKHQRIHTRVKALSTS

SEQ ID NO: 13083 - protein, 585 aa, Homo sapiens
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGGEKTLLHGKHERTHTKTRFSENAKCIHTKFQVFKHQRTQKIEKPHACIECEQTFLRKSQLIYHENICIQENPGSGQCEKLSRSVLFTKHLKTNTTDKICIPNEYRKGSTVKSSLITHQQTHTEEKSYMCSECGKGFTMKRYLIAHQRTHSGEKPYVCKECGKGFTVKSNLIVHQRTHTGEKPYICSECGKGFTMKRYLVVHQRTHTGEKPYMCSECGKGFTVKSNLIVHQRSHTGEKSYICSECGKGFTVKRTLVIHQRTHTGEKSYICNECGKGFTTKRTLIIHQRTHTGEKPYECNECGKAFSQKICLIQHERCHTGKTPFVCTECGKSYSHKYGLITHQRIHTGEKPYECNECGKAFTTKSVLNVHQRTHTGERPYGCSDCEKAFSHLSNLVKHKKMHTREMGRISQVENSCNGESQLLPYK

SEQ ID NO: 13084 - protein, 1016 aa, Homo sapiens
MEELSSGQAGQDYLVGTGGGRQFAVDSFHLSGTVTEPAIQSEPETVCNVAISFDRCKITSVTCSCGNKDIFYCAHVVALSLYRIRKPDQVKLHLPISETLFQMNRDQLQKFVQYLITVHHTEVLPTAQKLADEILSQNSEINQVHGAPDPTAGASIDDENCWHLDEEQVQEQVKLFLSQGGYHGSGKQLNLLFAKVREMLKMRDSNGARMLTLITEQFMADPRLSLWRQQGTAMTDKYRQLWDELGALWMCIVLNPHCKLEQKASWLKQLKKWNSVDVCPWEDGNHGSELPNLTNALPQGANANQDSSNRPHRTVFTRAIEACDLHWQDSHLQHIISSDLYTNYCYHDDTENSLFDSRGWPLWHEHVPTACARVDALRSHGYPREALRLAIAIVNTLRRQQQKQLEMFRTQKKELPHKNITSITNLEGWVGHPLDPVGTLFSSLMEACRIDDENLSGFSDFTENMGQCKSLEYQHLPAHKFLEEGESYLTLAVEVALIGLGQQRIMPDGLYTQEKVCRNEEQLISKLQEIELDDTLVKIFRKQAVFLLEAGPYSGLGEIIHRESVPMHTFAKYLFTSLLPHDAELAYKIALRAMRLLVLESTAPSGDLTRPHHIASVVPNRYPRWFTLSHIESQQCELASTMLTAAKGDVRRLETVLESIQKNIHSSSHIFKLAQDAFKIATLMDSLPDITLLKVSLELGLQVMRMTLSTLNWRRREMVRWLVTCATEVGVYALDSIMQTWFTLFTPTEATSIVATTVMSNSTIVRLHLDCHQQEKLASSARTLALQCAMKDPQNCALSALTLCEKDHIAFETAYQIVLDAATTGMSYTQLFTIARYMEHRGYPMRAYKLATLAMTHLNLSYNQDTHPAINDVLWACALSHSLGKNELAAIIPLVVKSVKCATVLSDILRRCTLTTPGMVGLHGRRNSGKLMSLDKAPLRQLLDATIGAYINTTHSRLTHISPRHYSEFIEFLSKARETFLMAHDGHIQFTQFIDNLKQIYKGKKKLMMLVRERFG

SEQ ID NO: 13085 - protein, 1016 aa, Homo sapiens; identical to SEQ ID NO: 13084

SEQ ID NO: 13086 - DNA, 17 bp, Homo sapiens
gatcttctctggtggta

SEQ ID NO: 13087 - DNA, 17 bp, Homo sapiens
gatccggctcttctgca

SEQ ID NO: 13088 - DNA, 17 bp, Homo sapiens
gatcacctgagcccaca

SEQ ID NO: 13089 - DNA, 17 bp, Homo sapiens
gatcatgtgacgcagaa

SEQ ID NO: 13090 - DNA, 17 bp, Homo sapiens
gatctattcccttaccc

SEQ ID NO: 13091 - DNA, 17 bp, Homo sapiens
gatccgtgtattgaatt

SEQ ID NO: 13092 - DNA, 17 bp, Homo sapiens
gatccagttctatgaat

SEQ ID NO: 13093 - DNA, 17 bp, Homo sapiens
gatctacatgtggacat

SEQ ID NO: 13094 - DNA, 17 bp, Homo sapiens
gatcatattactttctt

SEQ ID NO: 13095 - DNA, 17 bp, Homo sapiens
gatcggaacttgggcag

SEQ ID NO: 13096 - DNA, 17 bp, Homo sapiens
gatcggttgcacaatac

SEQ ID NO: 13097 - DNA, 17 bp, Homo sapiens
gatctgtttgaaagaaa

SEQ ID NO: 13098 - DNA, 17 bp, Homo sapiens
gatctggtcaggattta

SEQ ID NO: 13099 - DNA, 17 bp, Homo sapiens
gatcatctcctagcaca

SEQ ID NO: 13100 - DNA, 17 bp, Homo sapiens
gatctgttgtccaaaat

SEQ ID NO: 13101 - DNA, 17 bp, Homo sapiens
gatcatgaatgatgtgc

SEQ ID NO: 13102 - DNA, 17 bp, Homo sapiens
gatctttgttatctttt

SEQ ID NO: 13103 - DNA, 17 bp, Homo sapiens
gatcgtgcatcatgtat

SEQ ID NO: 13104 - DNA, 17 bp, Homo sapiens
gatcctctttggaccac

SEQ ID NO: 13105 - DNA, 17 bp, Homo sapiens
gatccatccgcctccac

SEQ ID NO: 13106 - DNA, 17 bp, Homo sapiens
gatctatattttttatt

SEQ ID NO: 13107 - DNA, 17 bp, Homo sapiens
gatccggctcccaagga

SEQ ID NO: 13108 - DNA, 17 bp, Homo sapiens
gatccattcttttttat

SEQ ID NO: 13109 - DNA, 17 bp, Homo sapiens
gatctactttattaagt

SEQ ID NO: 13110 - DNA, 17 bp, Homo sapiens
gatcacaagcagagcca

SEQ ID NO: 13111 - DNA, 17 bp, Homo sapiens
gatccttcatatcatac

SEQ ID NO: 13112 - DNA, 17 bp, Homo sapiens
gatctttcattagtgtg

SEQ ID NO: 13113 - DNA, 17 bp, Homo sapiens
gatcctattaataataa

SEQ ID NO: 13114 - DNA, 17 bp, Homo sapiens
gatcatatcatgccact

SEQ ID NO: 13115 - DNA, 17 bp, Homo sapiens
gatcaggggtggggggg

SEQ ID NO: 13116 - DNA, 17 bp, Homo sapiens
gatcatttcaaatgcca

SEQ ID NO: 13117 - DNA, 17 bp, Homo sapiens
gatctgtatgttgaaaa

SEQ ID NO: 13118 - DNA, 17 bp, Homo sapiens
gatccatttccctcttt

SEQ ID NO: 13119 - DNA, 17 bp, Homo sapiens
gatccttatcagatttg

SEQ ID NO: 13120 - DNA, 17 bp, Homo sapiens
gatcctctatgagatgc

SEQ ID NO: 13121 - DNA, 17 bp, Homo sapiens
gatcctaaaataagctt

SEQ ID NO: 13122 - DNA, 17 bp, Homo sapiens
gatcccgggacacaata

SEQ ID NO: 13123 - DNA, 17 bp, Homo sapiens
gatcccttctatgaaat

SEQ ID NO: 13124 - DNA, 17 bp, Homo sapiens
gatccccccaaaaagga

SEQ ID NO: 13125 - DNA, 17 bp, Homo sapiens
gatcaagcagtcctccc

SEQ ID NO: 13126 - DNA, 17 bp, Homo sapiens
gatcatgtttttactaa

SEQ ID NO: 13127 - DNA, 17 bp, Homo sapiens
gatccgtctctgtcctg

SEQ ID NO: 13128 - DNA, 17 bp, Homo sapiens
gatcgtggaagccgaag

SEQ ID NO: 13129 - DNA, 17 bp, Homo sapiens
gatcaagtttttgctct

SEQ ID NO: 13130 - DNA, 17 bp, Homo sapiens
gatcagtgtttttcaaa

SEQ ID NO: 13131 - DNA, 17 bp, Homo sapiens
gatccaaaaaagaattg

SEQ ID NO: 13132 - DNA, 17 bp, Homo sapiens
gatctaataatatttgt

SEQ ID NO: 13133 - DNA, 17 bp, Homo sapiens
gatctgtagtttttaaa

SEQ ID NO: 13134 - DNA, 17 bp, Homo sapiens
gatcatggcctttgaat

SEQ ID NO: 13135 - DNA, 17 bp, Homo sapiens
gatcatgttcacttgca

SEQ ID NO: 13136 - DNA, 17 bp, Homo sapiens
gatcctggaaactaaag

SEQ ID NO: 13137 - DNA, 17 bp, Homo sapiens
gatcgtccttcactccc

SEQ ID NO: 13138 - DNA, 17 bp, Homo sapiens
gatctgccatttctaac

SEQ ID NO: 13139 - DNA, 17 bp, Homo sapiens
gatctgaaatatccaga

SEQ ID NO: 13140 - DNA, 17 bp, Homo sapiens
gatctcacgcatacaac

SEQ ID NO: 13141 - DNA, 17 bp, Homo sapiens
gatctcagctgcagtat

SEQ ID NO: 13142 - DNA, 17 bp, Homo sapiens
gatccatgaaccaggca

SEQ ID NO: 13143 - DNA, 17 bp, Homo sapiens
gatcatagcacgttgta

SEQ ID NO: 13144 - DNA, 17 bp, Homo sapiens
gatctggctgctacttg

SEQ ID NO: 13145 - DNA, 17 bp, Homo sapiens
gatcaaatgcttttgtg

SEQ ID NO: 13146 - DNA, 17 bp, Homo sapiens
gatctcttaagactgta

SEQ ID NO: 13147 - DNA, 17 bp, Homo sapiens
gatctggcccctgccca

SEQ ID NO: 13148 - DNA, 17 bp, Homo sapiens
gatctgataatggcatt

SEQ ID NO: 13149 - DNA, 17 bp, Homo sapiens
gatctgcactgtatctt

SEQ ID NO: 13150 - DNA, 17 bp, Homo sapiens
gatcagcctccggccac

SEQ ID NO: 13151 - DNA, 17 bp, Homo sapiens
gatcagcatcattaata

SEQ ID NO: 13152 - DNA, 17 bp, Homo sapiens
gatcatttctccctatt

SEQ ID NO: 13153 - DNA, 17 bp, Homo sapiens
gatcaagttacttgctg

SEQ ID NO: 13154 - DNA, 17 bp, Homo sapiens
gatctgtctgatgtttc

SEQ ID NO: 13155 - DNA, 17 bp, Homo sapiens
gatcatttttctctttt

SEQ ID NO: 13156 - DNA, 17 bp, Homo sapiens
gatctcctcccgcgggc

SEQ ID NO: 13157 - DNA, 17 bp, Homo sapiens
gatcctgttcctgccac

SEQ ID NO: 13158 - DNA, 17 bp, Homo sapiens
gatcctttttcaactga

SEQ ID NO: 13159 - DNA, 17 bp, Homo sapiens
gatcccaggaatcagag

SEQ ID NO: 13160 - DNA, 17 bp, Homo sapiens
gatctttctctttcttt

SEQ ID NO: 13161 - DNA, 17 bp, Homo sapiens
gatctaataggtgtgag

SEQ ID NO: 13162 - DNA, 17 bp, Homo sapiens
gatcctccctgagcaaa

SEQ ID NO: 13163 - DNA, 17 bp, Homo sapiens
gatctcagctgctcggg

SEQ ID NO: 13164 - DNA, 17 bp, Homo sapiens
gatcaactacaatctgc

SEQ ID NO: 13165 - DNA, 17 bp, Homo sapiens
gatcattccagtgcact

SEQ ID NO: 13166 - DNA, 17 bp, Homo sapiens
gatcttacagtcattgg

SEQ ID NO: 13167 - DNA, 17 bp, Homo sapiens
gatcaaaaacgcagctt

SEQ ID NO: 13168 - DNA, 17 bp, Homo sapiens
gatccccgggaaccaga

SEQ ID NO: 13169 - DNA, 17 bp, Homo sapiens
gatcattacaaactttt

SEQ ID NO: 13170 - DNA, 17 bp, Homo sapiens
gatcgtcccatcagttg

SEQ ID NO: 13171 - DNA, 17 bp, Homo sapiens
gatctagcaaatatcaa

SEQ ID NO: 13172 - DNA, 17 bp, Homo sapiens
gatccgagtctgcttat

SEQ ID NO: 13173 - DNA, 17 bp, Homo sapiens
gatcatacctatgtgtc

SEQ ID NO: 13174 - DNA, 17 bp, Homo sapiens
gatcagtattgataaat

SEQ ID NO: 13175 - DNA, 17 bp, Homo sapiens
gatctgttttctaaaaa

SEQ ID NO: 13176 - DNA, 17 bp, Homo sapiens
gatcgcccagctgccag

SEQ ID NO: 13177 - DNA, 17 bp, Homo sapiens
gatctccacagcttgaa

SEQ ID NO: 13178 - DNA, 17 bp, Homo sapiens
gatctgccgcctcggcc

SEQ ID NO: 13179 - DNA, 17 bp, Homo sapiens
gatctgtaacagtcacc

SEQ ID NO: 13180 - DNA, 17 bp, Homo sapiens
gatcactctgttctctt

SEQ ID NO: 13181 - DNA, 17 bp, Homo sapiens
gatctgtcagttctaag

SEQ ID NO: 13182 - DNA, 17 bp, Homo sapiens
gatccagcaaaagaaaa

SEQ ID NO: 13183 - DNA, 17 bp, Homo sapiens
gatctggctggtgtttt

SEQ ID NO: 13184 - DNA, 17 bp, Homo sapiens
gatcaaaacgggcaact

SEQ ID NO: 13185 - DNA, 17 bp, Homo sapiens
gatccacaggattcaaa

SEQ ID NO: 13186 - DNA, 17 bp, Homo sapiens
gatctacaatctgctat

SEQ ID NO: 13187 - DNA, 17 bp, Homo sapiens
gatcagagaaggaaagg

SEQ ID NO: 13188 - DNA, 17 bp, Homo sapiens
gatcctgaagaagttat

SEQ ID NO: 13189 - DNA, 17 bp, Homo sapiens
gatcatgagtgcccgtg

SEQ ID NO: 13190 - DNA, 17 bp, Homo sapiens
gatcattctggatattt

SEQ ID NO: 13191 - DNA, 17 bp, Homo sapiens
gatcccactgttttact

SEQ ID NO: 13192 - DNA, 17 bp, Homo sapiens
gatcacaccactgtagt

SEQ ID NO: 13193 - DNA, 17 bp, Homo sapiens
gatctctgtctctccta

SEQ ID NO: 13194 - DNA, 17 bp, Homo sapiens
gatccctctgtattatt

SEQ ID NO: 13195 - DNA, 17 bp, Homo sapiens
gatcttgcaaaatataa

SEQ ID NO: 13196 - DNA, 17 bp, Homo sapiens
gatcaggttcaatttat

SEQ ID NO: 13197 - DNA, 17 bp, Homo sapiens
gatctatttgtatctct

SEQ ID NO: 13198 - DNA, 17 bp, Homo sapiens
gatcacagaacacacac

SEQ ID NO: 13199 - DNA, 17 bp, Homo sapiens
gatcatctgaaatcaga

SEQ ID NO: 13200 - DNA, 17 bp, Homo sapiens
gatcctcccacccacct

SEQ ID NO: 13201 - DNA, 17 bp, Homo sapiens
gatcaactgtatcggaa

SEQ ID NO: 13202 - DNA, 17 bp, Homo sapiens
gatccactttggtaact

SEQ ID NO: 13203 - DNA, 17 bp, Homo sapiens
gatcaagttctcatatt

SEQ ID NO: 13204 - DNA, 17 bp, Homo sapiens
gatccaattttatcttt

SEQ ID NO: 13205 - DNA, 17 bp, Homo sapiens
gatcccaaggttttgga

SEQ ID NO: 13206 - DNA, 17 bp, Homo sapiens
gatctgtattttgttta

SEQ ID NO: 13207 - DNA, 17 bp, Homo sapiens
gatctgttaccataaat

SEQ ID NO: 13208 - DNA, 17 bp, Homo sapiens
gatcctttgctccactg

SEQ ID NO: 13209 - DNA, 17 bp, Homo sapiens
gatcatgctgagatgca

SEQ ID NO: 13210 - DNA, 17 bp, Homo sapiens
gatcgttctaattattg

SEQ ID NO: 13211 - DNA, 17 bp, Homo sapiens
gatccaaggattgctta

SEQ ID NO: 13212 - DNA, 17 bp, Homo sapiens
gatcgcgccagtgcgct

SEQ ID NO: 13213 - DNA, 17 bp, Homo sapiens
gatcgtaccattgcatt

SEQ ID NO: 13214 - DNA, 17 bp, Homo sapiens
gatctgggttggatatg

SEQ ID NO: 13215 - DNA, 17 bp, Homo sapiens
gatccctcccaaatccc

SEQ ID NO: 13216 - DNA, 17 bp, Homo sapiens
gatcagtaattcaggga

SEQ ID NO: 13217 - DNA, 17 bp, Homo sapiens
gatccagggtgcaggtg

SEQ ID NO: 13218 - DNA, 17 bp, Homo sapiens
gatctgtatgattagga

SEQ ID NO: 13219 - DNA, 17 bp, Homo sapiens
gatcctcagttatttct

SEQ ID NO: 13220 - DNA, 17 bp, Homo sapiens
gatcatgcaaaatgcac

SEQ ID NO: 13221 - DNA, 17 bp, Homo sapiens
gatcatattaccaagtt

SEQ ID NO: 13222 - DNA, 17 bp, Homo sapiens
gatcatgaaatttttga

SEQ ID NO: 13223 - DNA, 17 bp, Homo sapiens
gatccttagttgatgtt

SEQ ID NO: 13224 - DNA, 17 bp, Homo sapiens
gatccatactattgata

SEQ ID NO: 13225 - DNA, 17 bp, Homo sapiens
gatcagctattacagag

SEQ ID NO: 13226 - DNA, 17 bp, Homo sapiens
gatccttgggtatgaaa

SEQ ID NO: 13227 - DNA, 17 bp, Homo sapiens
gatccagatacatagaa

SEQ ID NO: 13228 - DNA, 17 bp, Homo sapiens
gatcctgcttacacatt

SEQ ID NO: 13229 - DNA, 17 bp, Homo sapiens
gatccggtctaacacag

SEQ ID NO: 13230 - DNA, 17 bp, Homo sapiens
gatcaagcagtattttt

SEQ ID NO: 13231 - DNA, 17 bp, Homo sapiens
gatctgctaagtatatt

SEQ ID NO: 13232 - DNA, 17 bp, Homo sapiens
gatcctactctgaatct

SEQ ID NO: 13233 - DNA, 17 bp, Homo sapiens
gatctccctctccctta

SEQ ID NO: 13234 - DNA, 17 bp, Homo sapiens
gatcaaactcaaaagaa

SEQ ID NO: 13235 - DNA, 17 bp, Homo sapiens
gatcccgtttttgacat

SEQ ID NO: 13236 - DNA, 17 bp, Homo sapiens
gatcctgtcttgtattt

SEQ ID NO: 13237 - DNA, 17 bp, Homo sapiens
gatctggttttttaaaa

SEQ ID NO: 13238 - DNA, 17 bp, Homo sapiens
gatcagaaaagtcaggg

SEQ ID NO: 13239 - DNA, 17 bp, Homo sapiens
gatccttgcattaaatt

SEQ ID NO: 13240 - DNA, 17 bp, Homo sapiens
gatctgctagaacttca

SEQ ID NO: 13241 - DNA, 17 bp, Homo sapiens
gatccaaataagactaa

SEQ ID NO: 13242 - DNA, 17 bp, Homo sapiens
gatctgtagaagtctgt

SEQ ID NO: 13243 - DNA, 17 bp, Homo sapiens
gatctgggctcagaaga

SEQ ID NO: 13244 - DNA, 17 bp, Homo sapiens
gatctgctccttcagca

SEQ ID NO: 13245 - DNA, 17 bp, Homo sapiens
gatctccaaactctttc

SEQ ID NO: 13246 - DNA, 17 bp, Homo sapiens
gatccttgagaaaatat

SEQ ID NO: 13247 - DNA, 17 bp, Homo sapiens
gatcccttttactctgt

SEQ ID NO: 13248 - DNA, 17 bp, Homo sapiens
gatcatgtcatgctccc

SEQ ID NO: 13249 - DNA, 17 bp, Homo sapiens
gatccacctaacaagaa

SEQ ID NO: 13250 - DNA, 17 bp, Homo sapiens
gatctagccctggccac

SEQ ID NO: 13251 - DNA, 17 bp, Homo sapiens
gatctattcttcagata

SEQ ID NO: 13252 - DNA, 17 bp, Homo sapiens
gatcatagctcactcta

SEQ ID NO: 13253 - DNA, 17 bp, Homo sapiens
gatccgagttgttgcca

SEQ ID NO: 13254 - DNA, 17 bp, Homo sapiens
gatccaactcatacttg

SEQ ID NO: 13255 - DNA, 17 bp, Homo sapiens
gatctcaagcagtaaat

SEQ ID NO: 13256 - DNA, 17 bp, Homo sapiens
gatctacatattctggg

SEQ ID NO: 13257 - DNA, 17 bp, Homo sapiens
gatcctctgtatttctg

SEQ ID NO: 13258 - DNA, 17 bp, Homo sapiens
gatcaacgtcatgttcc

SEQ ID NO: 13259 - DNA, 17 bp, Homo sapiens
gatccacaaaaggacgc

SEQ ID NO: 13260 - DNA, 17 bp, Homo sapiens
gatctgagcatgtgagt

SEQ ID NO: 13261 - DNA, 17 bp, Homo sapiens
gatcagaccgttccctt

SEQ ID NO: 13262 - DNA, 17 bp, Homo sapiens
gatcataaggagaagat

SEQ ID NO: 13263 - DNA, 17 bp, Homo sapiens
gatcttaaaaataataa

SEQ ID NO: 13264 - DNA, 17 bp, Homo sapiens
gatcattttcttctgtg

SEQ ID NO: 13265 - DNA, 411 bp, Homo sapiens
atgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacagatgtctatacctgagatccgacaatgtggtagaaggcaactgtgctgatgaattactacaaaactcccatcgcgtcgtggaggagtactttgtggcccccccaggtaatatctctttgccaaagctggatgaacaagagccattcccacacagctga

SEQ ID NO: 13266 - DNA, 3587 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 13267 - DNA, 3500 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 13268 - DNA, 3572 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 13269 - DNA, 3668 bp, Homo sapiens
gggggctggagagagtgaggaggaaggggaggaggtgccgtcccacaataccaggcgggagggcgggtaggcggtttgtatccgggctgtgaggtgctcggagcctcggcggaccttgctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacagactgtggatattcataaggagaaagtggcacgaagagagattggtattttgacaacaaataagaatacatcaagaactcacaaaataatagcacctgcgaatatggagcgccctgtaaggtatattcggaaacctatcgattacacagttctggatgatgtgggccatggtgtcaagtggctaaaagccaagcatggaaataaccagcctgcaagaactggcacactgtcgagaacaaatcctcctactcagaaaccgccaagtcctcccatgtcaggccggggaacactgggacggaatactccttataaaaccctggaacctgttaaacccccaacagttcctaatgactatatgaccagtcctgctaggcttggaagtcagcatagtccaggcaggacagcatctttaaatcagagaccaaggacacacagtggaagtagtggaggaagtggaagtcgagaaaacagtggtagcagtagtattggcattcccattgctgtgcctacaccttcgccacccactattggaccagaaaacatttctgtccctcctccttctggagctccaccagcaccacctctggcaccacttctcccagtgagcactgtgatagcagccccgggctcagctcctggttcccagtatggcacaatgaccaggcagatatctcgacacaactctactacttcttcgacatcttctggtggatacagacgaactccctctgtgactgctcaattttctgctcagcctcatgttaatggaggtccactttattctcaaaattcaatttctattgctccaccccctccccctatgcctcagttgactccacagatacctctcacaggcttcgtggccagggtgcaggaaaacattgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaagttgttgcaatatatgattatacaaaagacaaggatgatgagctgtcatttatggagggtgcaatcatttatgttataaagaagaatgatgatggctggtatgaaggagtctgcaatcgagtgactggtctgttccctgggaactatgttgaatcaatcatgcactatactgattaatttttttttttcttttgaagtagattcttattactcagtcatactgtgggactattatggttaacagaactgtcttaatatgttttaaaatgtgcccatattttcagaacatgctgttttattggtaaattgaatgtctacctgtaagcataaatctttgaggcagtttatgtattgctgaatagcaatttatacaagaagctgtccataactgattatgcttatgtacttacttacacatttttaactttatgaccagcctaaatattctgggggaagtggggtataatatttaacgaatcatgattcagattgtaccattacatgtttcagtgcagcatggttactaacgctatgtcagactaatattaaaatcagaaaatttaaatgctggtgctggtcagactttttttgttagattctctcatttaaaaaaaatactgtttgtttaaagcatgcataaaaatttatgtattgaaatatacttaaaaattcaagatgcttcccatttgtgtaatatttacctggaggactcgtacttaggtgtcttaacgtgaattgagtctccaaggtctccatgtgaaacaagcaaaaagagaattatctgtaatgttgtaatttgtacctaagttttttaatgagtgaaatttgcattataaactttttccattcataaatacataagtgaaccaaaggtttttgtcctttccttcactgatttgctttaaaaaaaataaaagataatgatttattgcagaattatgattctattttctcaatatgttaacttggaaaaaaattttagccttatcttaatctgtcccaacagcaatgtgacggatttttgcagattcaaaatctgcaatggttatttacaagtcaatctactgaattccttttttaaataatcttttgaaactaagaaaatgtgtcaaattgtgtgcattcattctgtaggtaaaattcttaaggattgccatgtcagtccttcagttgtacagtgaactgttgtacactggttcaatgaaaggaagttaaaagtaccttttacatattgtaaaagtggatacagttgatttgtgagtaggcactctttaatccattacctggcactagcaacattagaattttaaaataaaataattgggaaagaaggtgggtcatgtattaatcagtgaacagagatttacctaaccaacagacttggattgtcttttgacataatcaaaatgcaacacatgcactttgtgtgtctcctcttaattgaagggagggctgagggatgttttctcttcttgtcttgtgtataattctctattgcttaggatattaaagtagagcactcaagtgtgggtttctgtgttattgaggatttgtttggaattcaaattacagttatgtactggatgctacagacttataacagcatagtgaatggtaagactagtgcaaaacagttatttctgaaaattaaagaccattattgctaccaaatcaatgtgactatttcatatgcattttgcctttgttaattttaaacaaacaaagtatcattagtgatcagctagctaccttctactttccatttttcaagtggattgttctcttaatttgtatataacctgttgtctaaattttatgtacagtcttttataataaaccattctcctatatgaaattttggatactgttaaaatataactcatgtggacttcaatgcagacttcacatttttctgacctttactcctacggtaaatcaagacaaaccatttgaattttaacattggttatttatttgtgtaatggccttacatgtggatattaacagtgtaaacaataccacatataaccatcaagataccttgattataatttataggactagaatgacagattcaggtggtttattaattacatttaaaaagttttctgaaaaaacttttgcaataaaaaaaaataaattgcccatcaa

SEQ ID NO: 13270 - DNA, 3089 bp, Homo sapiens
agcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattaccccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataagtctgttctttaaatttctgaaatggaacagatttcaaaaaaaattcccacaatctagggtgggaacaaggaaggaaagatgtgaataggctgatggggaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggactccgaggtgggcagatcacttgagctcaggagctcaagatcagcctgggcaacatggtgaaaccttgtctctacataaaatacaaaaacttagatgggcatggtgctgtgtgcctatagtccactacttgtggggctaaggcaggaggatcacttgagccccggaggtcgaggctacagtgacccaagagtgcactactgtactccagccagggcaagagagcgagaccctgtctcaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttccatgtggcagatctacatgtctagagaacactgtgctctattaccattatggataaagatgagatggtttctagagatggtttctactggctgccagaatctagagcaaagccatcccccctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaaaaaaaaaa

SEQ ID NO: 13271 - DNA, 2666 bp, Homo sapiens
atgcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccaagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgcc

SEQ ID NO: 13272 - DNA, 2492 bp, Homo sapiens
gttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 13273 - DNA, 2642 bp, Homo sapiens
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagt

SEQ ID NO: 13274 - DNA, 5540 bp, Homo sapiens
aattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgtttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcgccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgttttttttttattaaagccaaatttgtgttgtatatattcgtattccatgtgttagatggaagcatttcctatccagtgtgaataaaaagaacagttgtagtaaattattataaagccgatgatatttcatggcaggttattctaccaagctgtgcttgttggtttttcccatgactgtattgcttttataaatgtacaaatagttactgaaatgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatcagaatgggcagagatgatcttgaagtgtcacatacactaaagtccaaacactatgtcagatgggggtaaaatccattaaagaacaggaaaaaataattataagatgataagcaaatgtttcagcccaatgtcaacccagttaaaaaaaaaattaatgctgtgtaaaatggttgaattagtttgcaaactatataaagacatatgcagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaaaaaaaaaaaaaaaaaaaa

SEQ ID NO: 13275 - DNA, 1315 bp, Homo sapiens
ggagataagagtatcttgcacagcaggtgcaggtttcccagcagctcaggcaagagtccgatgtttgtgccatctgatcctgatgtctggagagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttcttgcttgattgctttgttgggggcctggccacttccttgcttctcaagctgacaattctcactttgcaataaatagtccagtgtttccttccaaaaaaaa

SEQ ID NO: 13276 - DNA, 1853 bp, Homo sapiens
ggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagctt

SEQ ID NO: 13277 - DNA, 6031 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaataaaaaaaaaaaaaaaaa

SEQ ID NO: 13278 - DNA, 5935 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaaggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaataaaaaaaaaaaaaaaaa

SEQ ID NO: 13279 - DNA, 1746 bp, Homo sapiens
tgtgcctgcgctgccagcagccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagagcccacgtcctcagggacggtcctgccttgggacctttgcacttgctgttttctgtaattggaatgctctttgccagaaagctgcaagcctcgaccctcttttccttcaaatccctgcttcagtgtcaccactgcatcatggagggcctatttaaggcgaaaccacaatttctccaaaaggtgagttgtaagagtgatcacttgtcttaaaaggaggacaggcagtctctgccccatggggctgcatgggttttcggcatgacctctccctcccctggccacgtgggacgggcaaccatggcatggccaggagccctcatgccaggacagctgtgagaccaggaatcagcatcaccttgggacatgatggtacttggcaagatttaacatgaagctgtggggcatttgcccagttagagctgagaaaatggttttaacaggataggtaaactttttttcattctccaagacctatcctatgatagtgtccaatctaataattagccaatttagtccatttgatgaaaaaaattcccaaacatctcttcatgtcatcatgctatcagtttggctgggtatttgcatctcagtgctgctttggggtctcggagaggacgaagcctgtatgtggagggccggtctacagaaggggacaggatctcggacccctgattgaatgagcctatggatgaagactcctaggaatgaaggcatcttcaccagggttttgagaatcatcatttcacaatccacattccccagcttggcttttcctcacctcatgccccttgcatgtgccaaacccactgagaatttgctccctgtctgaccagcccaggatggtcacacaggcctggggcaatctcttgacctcactctcctgctttatgaaaaattttcaaatccaaagaaaagttgaaagaacgggacaatcaaaatatatacacccttcacctagggtcactcactgacacggtgccccctttgctttatctctgtgtacataagccttttttgactgatctacttgcaaattagtgtagatatcatgatatttcacccctgaatacagcaccattgtgtttcctattgtgtataatcacaatacagtgaccactcctaagaaaattaatgctaatttaatatcatctattatacagtccatatttaaatttctctggttatttcagaagtatcttttattgctctattttttattgtgctattttccaatccagaaaaaatatttgtatttattttgtcttttttttaagtctctttcagtattgaacagcccctctgctttttatccttatggcattgttaattgagaagtccctaagccccgttgtcttatacaatgtcccattttctggatttgtctgatcgttttctcctgagtagattcagattgaagtttttg

SEQ ID NO: 13280 - DNA, 830 bp, Homo sapiens
tcttgctgggccattgctctagaacctgctcagtaattagcacttgtttgagtcaattattgcccgaagtggaacatcagcctctggagccagtctgcaagaatgggacaggtggcgtgccatcctaagaagagaggacagcctctgctgaggccccgggcaagggcagcatggactacaggggttgtgcaagaggggagaatgagagatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggtgagggatgtggtgctcgggcctggctctgccccacccagcgaggcaccgagggccactctgtgatgctggctacagcaagaatgaacccacaagcgcagagcccaacaggctgtaaaggaaggcagtgacctctgcatgtttctgtctctctcactaaccctttgcctctgtttctctttcttctgtctctatctctctctgtctctctatttgtgttcctttttctgtctccctttccatgtctctgtctttctgtgtctctttccctctgtacttttcctttcagttgctcttggcagtcctgagaatcacatttcctggagaaaggtgggagaggaactaaaattggcttcacacagaaatttctgttctctcatccaaatgatgagatcaaataaacccagtcccagtaggcagcgaggtt

SEQ ID NO: 13281 - DNA, 1586 bp, Homo sapiens
gccaggagccaggagccaagagcagagcgccagcatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagaaagctgcaagcctcgaccctcttttccttcaaatccctgcttcagtgtcaccactgcatcatggagggcctatttaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggatctgct

SEQ ID NO: 13282 - DNA, 2062 bp, Homo sapiens
tcttgctgggccattgctctagaacctgctcagtaattagcacttgtttgagtcaattattgcccgaagtggaacatcagcctctggagccagtctgcaagaatgggacaggtggcgtgccatcctaagaagagaggacagcctctgctgaggccccgggcaagggcagcatggactacaggggttgtgcaagaggggagaatgagagatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggtgagggatgtggtgctcgggcctggctctgccccacccagcgaggcaccgagggccactctgtgatgctggctacagcaagaatgaacccacaagcgcagagcccaacaggctgtaaaggaaggcagtgacctctgcatgtttctgtctctctcactaaccctttgcctctgtttctctttcttctgtctctatctctctctgtctctctatttgtgttcctttttctgtctccctttccatgtctctgtctttctgtgtctctttccctctgtacttttcctttcagttgctcttggcagtcctgagaatcacatttcctggagaaaggtgggagaggaactaaaattggcttcacacagaaatttctgttctctcatccaaatgatgagatcaaataaacccagtcccagtaggcagcgagacaccatcccgctaaagaagagagccccaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggatctgct
